US011192936B2

(12) United States Patent
Chhabra et al.

(10) Patent No.: US 11,192,936 B2
(45) Date of Patent: Dec. 7, 2021

(54) FACTOR VIII CHIMERIC PROTEINS AND USES THEREOF

(71) Applicant: Bioverativ Therapeutics Inc., Waltham, MA (US)

(72) Inventors: Ekta Seth Chhabra, Framingham, MA (US); Tongyao Liu, Lexington, MA (US); Robert T. Peters, Needham, MA (US); John Kulman, Belmont, MA (US)

(73) Assignee: Bioverativ Therapeutics Inc., Waltham, MA (US)

( * ) Notice: Subject to any disclaimer, the term of this patent is extended or adjusted under 35 U.S.C. 154(b) by 751 days.

(21) Appl. No.: 15/110,673

(22) PCT Filed: Jan. 9, 2015

(86) PCT No.: PCT/US2015/010738
§ 371 (c)(1),
(2) Date: Jul. 8, 2016

(87) PCT Pub. No.: WO2015/106052
PCT Pub. Date: Jul. 16, 2015

(65) Prior Publication Data
US 2017/0073393 A1 Mar. 16, 2017

Related U.S. Application Data

(60) Provisional application No. 61/926,226, filed on Jan. 10, 2014, provisional application No. 61/988,104, filed on May 2, 2014.

(51) Int. Cl.
*C07K 14/755* (2006.01)
*C07K 16/00* (2006.01)
*A61K 38/00* (2006.01)

(52) U.S. Cl.
CPC ............ *C07K 14/755* (2013.01); *C07K 16/00* (2013.01); *A61K 38/00* (2013.01); *C07K 2319/00* (2013.01); *C07K 2319/30* (2013.01); *C07K 2319/31* (2013.01)

(58) Field of Classification Search
None
See application file for complete search history.

(56) References Cited

U.S. PATENT DOCUMENTS

| | | |
|---|---|---|
| 4,179,337 A | 12/1979 | Davis et al. |
| 4,215,051 A | 7/1980 | Palmer et al. |
| 4,683,195 A | 7/1987 | Mullis et al. |
| 4,683,202 A | 7/1987 | Mullis |
| 4,713,339 A | 12/1987 | Levinson et al. |
| 4,757,006 A | 7/1988 | Toole, Jr. et al. |
| 4,800,159 A | 1/1989 | Mullis et al. |
| 4,868,112 A | 9/1989 | Toole, Jr. |
| 4,965,188 A | 10/1990 | Mullis et al. |
| 4,965,199 A | 10/1990 | Capon et al. |
| 4,994,371 A | 2/1991 | Davie et al. |
| 5,004,803 A | 4/1991 | Kaufman et al. |
| 5,112,950 A | 5/1992 | Meulien et al. |
| 5,171,844 A | 12/1992 | Van Ooyen et al. |
| 5,364,771 A | 11/1994 | Lollar et al. |
| 5,543,502 A | 8/1996 | Nordfang et al. |
| 5,595,886 A | 1/1997 | Chapman et al. |
| 5,610,278 A | 3/1997 | Nordfang et al. |
| 5,643,575 A | 7/1997 | Martinez et al. |
| 5,648,260 A | 7/1997 | Winter et al. |
| 5,658,570 A | 8/1997 | Newman et al. |
| 5,739,277 A | 4/1998 | Presta et al. |
| 5,789,203 A | 8/1998 | Chapman et al. |
| 5,834,250 A | 11/1998 | Wells et al. |
| 5,846,951 A | 12/1998 | Gregoriadis |
| 5,859,204 A | 1/1999 | Lollar |
| 5,869,046 A | 2/1999 | Presta et al. |
| 5,972,885 A | 10/1999 | Spira et al. |
| 5,981,216 A | 11/1999 | Kenten et al. |
| 6,030,613 A | 2/2000 | Blumberg et al. |

(Continued)

FOREIGN PATENT DOCUMENTS

| | | |
|---|---|---|
| BR | 112015000267 A2 | 3/2018 |
| CN | 102076855 A | 5/2011 |

(Continued)

OTHER PUBLICATIONS

Agersoe, H., et al., "Prolonged Effect of N8-Gp in Haemophilia A Dogs Supports Less Frequent Dosing," Journal of Thrombosis and Haemostasis 9(Suppl. 2): 115, Abstract P-MO-181, Abstracts from 2011 ISTH Congress, International Society on Thrombosis and Haemostasis, United States (2011).

Alvarez,P., et al., "Improving Protein Pharmacokinetics by Genetic Fusion to Simple Amino Acid Sequences," The Journal of Biological Chemistry 279(5):3375-3381, American Society for Biochemistry and Molecular Biology, United States (2004).

Armour, K.L., et al., "Recombinant Human IgG Molecules Lacking Fc gamma Receptor I Binding and Monocyte Triggering Activities," European Journal of Immunology 29(8):2613-2624, Wiley-VCH, Germany (Aug. 1999).

(Continued)

*Primary Examiner* — Michael Szperka
(74) *Attorney, Agent, or Firm* — Lathrop GPM LLP; James H. Velema; James V. DeGiulio

(57) ABSTRACT

The present invention provides a chimeric protein comprising a first polypeptide which comprises a FVIII protein and a first Ig constant region or a portion thereof and a second polypeptide which comprises a VWF protein comprising the D' domain and D3 domain of VWF, a XTEN sequence having less than 288 amino acids in length, and a second Ig constant region or a portion thereof, wherein the first polypeptide and the second polypeptide are associated with each other. The invention also includes nucleotides, vectors, host cells, methods of using the chimeric proteins.

Figure 1:
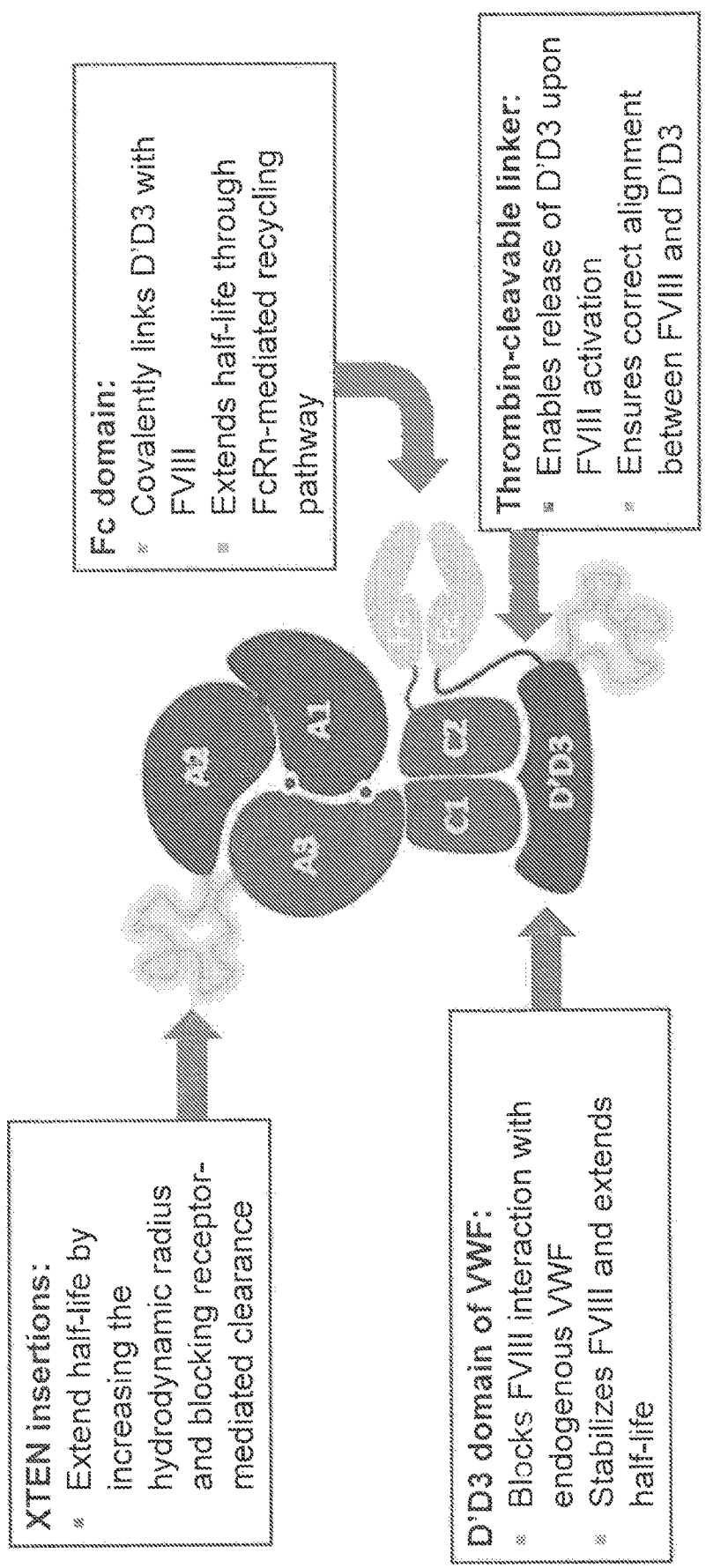

58 Claims, 14 Drawing Sheets
Specification includes a Sequence Listing.

(56) References Cited

U.S. PATENT DOCUMENTS

| | | | |
|---|---|---|---|
| 6,037,452 A | 3/2000 | Hitoshi | |
| 6,048,720 A | 4/2000 | Dalborg et al. | |
| 6,060,447 A | 5/2000 | Chapman et al. | |
| 6,086,875 A | 7/2000 | Blumberg et al. | |
| 6,096,871 A | 8/2000 | Presta et al. | |
| 6,121,022 A | 9/2000 | Presta et al. | |
| 6,194,551 B1 | 2/2001 | Idusogie et al. | |
| 6,228,620 B1 | 5/2001 | Chapman et al. | |
| 6,242,195 B1 | 6/2001 | Idusogie et al. | |
| 6,251,632 B1 | 6/2001 | Lillicrap et al. | |
| 6,277,375 B1 | 8/2001 | Ward | |
| 6,316,226 B1 | 11/2001 | Van Ooyen et al. | |
| 6,346,513 B1 | 2/2002 | Van Ooyen et al. | |
| 6,358,703 B1 | 3/2002 | Cho et al. | |
| 6,376,463 B1 | 4/2002 | Lollar | |
| 6,458,563 B1 | 10/2002 | Lollar | |
| 6,485,726 B1 | 11/2002 | Blumberg et al. | |
| 6,528,624 B1 | 3/2003 | Idusogie et al. | |
| 6,530,648 B2 | 3/2003 | Leu et al. | |
| 6,538,124 B1 | 3/2003 | Idusogie et al. | |
| 6,696,245 B2 | 2/2004 | Winter et al. | |
| 6,737,056 B1 | 5/2004 | Presta | |
| 6,818,439 B1 | 11/2004 | Jolly et al. | |
| 6,821,505 B2 | 11/2004 | Ward | |
| 6,998,253 B1 | 2/2006 | Presta et al. | |
| 7,041,635 B2 | 5/2006 | Kim et al. | |
| 7,083,784 B2 | 8/2006 | Dall'Acqua et al. | |
| 7,199,223 B2 | 4/2007 | Bossard et al. | |
| 7,211,559 B2 | 5/2007 | Saenko et al. | |
| 7,317,091 B2 | 1/2008 | Lazar et al. | |
| 7,348,004 B2 | 3/2008 | Peters et al. | |
| 7,404,956 B2 | 7/2008 | Peters et al. | |
| 7,566,701 B2 | 7/2009 | Diener et al. | |
| 7,620,601 B2 | 11/2009 | Miyawaki et al. | |
| 7,846,445 B2 | 12/2010 | Schellenberger et al. | |
| 7,862,820 B2 | 1/2011 | Peters et al. | |
| 10,138,291 B2 * | 11/2018 | Chhabra | C07K 14/755 |
| 10,370,430 B2 | 8/2019 | Kulman et al. | |
| 10,421,798 B2 | 9/2019 | Schellenberger et al. | |
| 2003/0065787 A1 | 4/2003 | Osafune et al. | |
| 2003/0069395 A1 | 4/2003 | Sato et al. | |
| 2003/0235536 A1 | 12/2003 | Blumberg | |
| 2004/0101740 A1 | 5/2004 | Sanders | |
| 2005/0100990 A1 | 5/2005 | Saenko et al. | |
| 2005/0147618 A1 | 7/2005 | Rivera | |
| 2006/0074199 A1 | 4/2006 | Hirata et al. | |
| 2006/0122376 A1 | 6/2006 | Chapman et al. | |
| 2007/0191597 A1 | 8/2007 | Jain et al. | |
| 2007/0231329 A1 | 10/2007 | Lazar et al. | |
| 2007/0237765 A1 | 10/2007 | Lazar et al. | |
| 2007/0237766 A1 | 10/2007 | Lazar et al. | |
| 2007/0237767 A1 | 10/2007 | Lazar et al. | |
| 2007/0243188 A1 | 10/2007 | Lazar et al. | |
| 2007/0248603 A1 | 10/2007 | Lazar et al. | |
| 2007/0286859 A1 | 12/2007 | Lazar et al. | |
| 2008/0004206 A1 | 1/2008 | Rosen et al. | |
| 2008/0057056 A1 | 3/2008 | Lazar et al. | |
| 2008/0146782 A1 | 6/2008 | Defrees et al. | |
| 2008/0153751 A1 | 6/2008 | Rosen et al. | |
| 2008/0161243 A1 | 7/2008 | Rosen et al. | |
| 2008/0194481 A1 | 8/2008 | Rosen et al. | |
| 2008/0261877 A1 | 10/2008 | Ballance et al. | |
| 2009/0118185 A1 | 5/2009 | Fay et al. | |
| 2009/0192076 A1 | 7/2009 | Matthiessen et al. | |
| 2009/0247459 A1 | 10/2009 | Schwarz et al. | |
| 2010/0120664 A1 | 5/2010 | Schulte et al. | |
| 2010/0183556 A1 | 7/2010 | Choi et al. | |
| 2010/0239554 A1 | 9/2010 | Schellenberger et al. | |
| 2010/0285021 A1 | 11/2010 | Jacquemin et al. | |
| 2010/0292130 A1 | 11/2010 | Skerra et al. | |
| 2010/0323956 A1 | 12/2010 | Schellenberger et al. | |
| 2011/0046060 A1 | 2/2011 | Schellenberger et al. | |
| 2011/0046061 A1 | 2/2011 | Schellenberger et al. | |
| 2011/0069164 A1 | 3/2011 | Ozawa et al. | |
| 2011/0077199 A1 | 3/2011 | Schellenberger et al. | |
| 2011/0124656 A1 | 5/2011 | Seth et al. | |
| 2011/0172146 A1 | 7/2011 | Schellenberger et al. | |
| 2011/0183907 A1 | 7/2011 | Weimer et al. | |
| 2011/0263595 A1 | 10/2011 | Zhang et al. | |
| 2011/0287517 A1 | 11/2011 | Steward et al. | |
| 2011/0288005 A1 | 11/2011 | Silverman et al. | |
| 2011/0312881 A1 | 12/2011 | Silverman et al. | |
| 2012/0121706 A1 | 5/2012 | Kuliopulos et al. | |
| 2012/0178691 A1 * | 7/2012 | Schellenberger | C07K 14/755 514/14.1 |
| 2012/0289468 A1 | 11/2012 | Barnett | |
| 2013/0017997 A1 | 1/2013 | Schellenberger et al. | |
| 2013/0108629 A1 | 5/2013 | Dumont et al. | |
| 2015/0023959 A1 | 1/2015 | Chhabra et al. | |
| 2015/0158929 A1 | 6/2015 | Schellenberger et al. | |
| 2015/0266943 A1 | 9/2015 | Chhabra et al. | |
| 2016/0200794 A1 | 7/2016 | Metzner et al. | |
| 2016/0229903 A1 | 8/2016 | Chhabra et al. | |
| 2016/0251408 A1 | 9/2016 | Chhabra et al. | |
| 2016/0355568 A1 | 12/2016 | Kulman et al. | |
| 2017/0073393 A1 | 3/2017 | Chhabra et al. | |
| 2019/0169267 A1 | 6/2019 | Chhabra et al. | |
| 2020/0095567 A1 | 3/2020 | Metzner et al. | |

FOREIGN PATENT DOCUMENTS

| | | |
|---|---|---|
| CN | 102348715 A | 2/2012 |
| CN | 102648212 A | 8/2012 |
| EP | 0295597 A2 | 12/1988 |
| EP | 1935430 A1 | 6/2008 |
| EP | 3013358 A1 | 5/2016 |
| EP | 3091997 A1 | 11/2016 |
| EP | 2256135 B1 | 3/2019 |
| JP | 2008-525491 A | 7/2008 |
| JP | 2009-505964 A1 | 2/2009 |
| JP | 2011-525363 A | 9/2011 |
| JP | 2013-525363 A | 10/2011 |
| JP | 2013-510581 A | 3/2013 |
| JP | 2013-512678 A | 4/2013 |
| JP | 2015-527882 A | 9/2015 |
| JP | 2016523919 A | 8/2016 |
| JP | 2017-503509 A | 2/2017 |
| WO | WO-8704187 A1 | 7/1987 |
| WO | WO-8800831 A1 | 2/1988 |
| WO | WO-8803558 A1 | 5/1988 |
| WO | WO-8807089 A1 | 9/1988 |
| WO | WO-8808035 A1 | 10/1988 |
| WO | WO-9109122 A1 | 6/1991 |
| WO | WO-9320093 A1 | 10/1993 |
| WO | WO-9411503 A2 | 5/1994 |
| WO | WO-9614339 A1 | 5/1996 |
| WO | WO-9805787 A1 | 2/1998 |
| WO | WO-9823289 A1 | 6/1998 |
| WO | WO-9951642 A1 | 10/1999 |
| WO | WO-9958572 A1 | 11/1999 |
| WO | WO-0009560 A2 | 2/2000 |
| WO | WO-0032767 A1 | 6/2000 |
| WO | WO-0042072 A2 | 7/2000 |
| WO | WO 2001/007072 A1 | 2/2001 |
| WO | WO-2001087922 A2 | 11/2001 |
| WO | WO-0244215 A2 | 6/2002 |
| WO | WO-02060919 A2 | 8/2002 |
| WO | WO 2003/074569 A2 | 9/2003 |
| WO | WO-03074569 A2 | 9/2003 |
| WO | WO-03077834 A2 | 9/2003 |
| WO | WO-2004016750 A2 | 2/2004 |
| WO | WO-2004029207 A2 | 4/2004 |
| WO | WO-2004035752 A2 | 4/2004 |
| WO | WO-2004044859 A1 | 5/2004 |
| WO | WO-2004063351 A2 | 7/2004 |
| WO | WO-2004067566 A1 | 8/2004 |
| WO | WO 2004/076484 A1 | 9/2004 |
| WO | WO-2004074455 A2 | 9/2004 |
| WO | WO-2004099249 A2 | 11/2004 |
| WO | WO-2005040217 A2 | 5/2005 |
| WO | WO-2005047327 A2 | 5/2005 |
| WO | WO-2005070963 A1 | 8/2005 |
| WO | WO-2005077981 A2 | 8/2005 |
| WO | WO-2005092925 A2 | 10/2005 |

(56) References Cited

FOREIGN PATENT DOCUMENTS

| WO | WO-2005123780 A2 | 12/2005 | | |
|---|---|---|---|---|
| WO | WO-2006019447 A1 | 2/2006 | | |
| WO | WO-2006047350 A2 | 5/2006 | | |
| WO | 2006071801 A2 | 7/2006 | | |
| WO | WO-2006085967 A2 | 8/2006 | | |
| WO | WO 2007/015107 A2 | 2/2007 | | |
| WO | WO-2007021494 A2 | 2/2007 | | |
| WO | WO 2007/090584 A1 | 8/2007 | | |
| WO | WO-2007103515 A2 | 9/2007 | | |
| WO | WO-2007144173 A1 | 12/2007 | | |
| WO | WO-2008033413 A2 | 3/2008 | | |
| WO | WO-2008057683 A2 | 5/2008 | | |
| WO | WO-2008077616 A1 | 7/2008 | | |
| WO | WO-2008155134 A1 | 12/2008 | | |
| WO | WO-2009023270 A3 | 2/2009 | | |
| WO | WO-2009058322 A1 | 5/2009 | | |
| WO | WO-2009062100 A1 | 5/2009 | | |
| WO | WO-2009156137 A1 * | 12/2009 | ........... | C07K 14/755 |
| WO | WO-2010060081 A1 | 5/2010 | | |
| WO | WO-2010091122 A1 | 8/2010 | | |
| WO | WO-2010111414 A1 | 9/2010 | | |
| WO | WO-2010144502 A2 | 12/2010 | | |
| WO | WO-2010144508 A1 | 12/2010 | | |
| WO | WO-2011020866 A2 | 2/2011 | | |
| WO | WO-2011028228 A1 | 3/2011 | | |
| WO | WO-2011028229 A1 | 3/2011 | | |
| WO | WO-2011028344 A2 | 3/2011 | | |
| WO | WO-2011060242 A2 * | 5/2011 | ........... | C07K 14/755 |
| WO | WO-2011069164 A2 * | 6/2011 | ............ | A61K 38/37 |
| WO | WO-2011101242 A1 | 8/2011 | | |
| WO | WO-2011101284 A1 | 8/2011 | | |
| WO | WO-2011060242 A2 | 10/2011 | | |
| WO | WO-2012006623 A1 | 1/2012 | | |
| WO | WO-2012006633 A1 | 1/2012 | | |
| WO | WO-2012006635 A1 | 1/2012 | | |
| WO | 2011133637 A3 | 2/2012 | | |
| WO | WO-201 3083858 | 6/2013 | | |
| WO | WO 2013/106787 A1 | 7/2013 | | |
| WO | WO-2013106787 A1 * | 7/2013 | ........... | C07K 14/755 |
| WO | WO-201 3123457 A1 | 8/2013 | | |
| WO | WO-2013122617 A1 * | 8/2013 | ........... | C07K 14/755 |
| WO | WO 2014/011819 A2 | 1/2014 | | |
| WO | WO-2014011819 A2 | 1/2014 | | |
| WO | WO-201 4210547 A1 | 12/2014 | | |
| WO | WO-201 4210558 A1 | 12/2014 | | |
| WO | WO 2014/210558 A1 | 12/2014 | | |
| WO | WO-2014210448 A1 | 12/2014 | | |
| WO | WO 2015/106052 A1 | 7/2015 | | |
| WO | WO-2015106052 A1 | 7/2015 | | |

OTHER PUBLICATIONS

Arnau, J., et al., "Current Strategies for the use of Affinity Tags and Tag Removal for the Purification of Recombinant Proteins," Protein Expression and Purification 48(1):1-13, Elsevier Inc., United States (Jul. 2006).

Benhar, I. and Pastan, I., "Cloning, Expression and Characterization of the Fv Fragments of the Anti-carbohydrate mAbs B1 and B5 as Single-chain Immunotoxins," Protein Engineering Design and Selection 7(11):1509-1515, Oxford University Press, England (Dec. 1994).

Burmeister, W.P., et al., "Crystal Structure of the Complex of Rat Neonatal Fc Receptor with Fc," Nature 372(6504):379-383, Nature Publishing Group, England (Nov. 1994).

Cameron, C., et al., "The Canine Factor VIII cDNA and 5' Flanking Sequence," Thrombosis and Haemostasis 79(2):317-322, Schattauer, Germany (Feb. 1998).

Capon, D.J., et al., "Designing CD4 Immunoadhesins for AIDS Therapy," Nature 337(6207):525-531, Nature Publishing Group, England (Feb. 1989).

Dumont, J.A., et al., "Prolonged Activity of a Recombinant Factor VIII-Fc Fusion Protein in Hemophilia a Mice and Dogs," Blood 119(13):3024-3030, The American Society of Hematology, United States (Mar. 2012).

Eaton, D.L., et al., "Construction and Characterization of an Active Factor VIII Variant Lacking the Central One-third of the Molecule," Biochemistry 25(26):8343-8347, American Chemical Society, United States (Dec. 1986).

Friend, P.J., et al., "Phase I Study of an Engineered Aglycosylated Humanized CD3 Antibodyin Renal Transplant Rejection," Transplantation 68(11):1632-1637, Lippincott Williams & Wilkins, Inc., United States (Dec. 1999).

Genbank, "*Homo sapiens* von Willebrand factor (VWF), mRNA" NCBI Reference Sequence: NM_000552.3, accessed at http://www.ncbi.nlm.nih.gov/nuccore/NM_000552.3, accessed on Mar. 29, 2016, 10 pages.

Genbank, "Von Willebrand factor preproprotein [*Homo sapiens*]," NCBI Reference Sequence: NP_000543.2, accessed at http://www.ncbi.nlm.nih.gov/protein/NP_000543.2, accessed on Mar. 29, 2016, 6 pages.

Gitschier, J., et al., "Characterization of the Human Factor VIII Gene," Nature 312(5992):326-330, Nature Publishing Group, England (Nov. 1984).

Goudemand, J., et al., "Pharmacokinetic Studies on Wilfactin, a Von Willebrand Factor Concentrate with a Low Factor VIII Content Treated with Three Virus-inactivation/removal Methods," Journal of Thrombosis and Haemostasis 3(10):2219-2227, Blackwell Publishers, England (Oct. 2005).

Graw, J., et al., "Haemophilia A: From Mutation Analysis to New Therapies," Nature Reviews. Genetics 6(6):488-501, Nature Publishing Group, England (Jun. 2005).

Healey, J.F., et al., "The cDNA and Derived Amino Acid Sequence of Porcine Factor VIII," Blood 88(11):4209-4214, The American Society of Hematology, United States (Dec. 1996).

Ho, S.N., et al., "Site-directed Mutagenesis by Overlap Extension using the Polymerase Chain Reaction," Gene 77(1):51-59, Elsevier Science Publishers B.V., Netherlands (Apr. 1989).

Hoeben, R.C., et al., "Expression of Functional Factor VIII in Primary Human Skin Fibroblasts after Retrovirus-mediated Gene Transfer," The Journal of Biological Chemistry 265(13):7318-7323, The American Society for Biochemistry and Molecular Biology, United States (May 1990).

Horton, R.M., et al., "Gene Splicing by Overlap Extension," Methods in Enzymology 217:270-279, Academic Press, United States (1993).

Co-pending Application, U.S. Appl. No. 16/154,310, inventors Chhabra, Ekta Seth., et al., filed Oct. 8, 2018 (Not Published).

International Search Report and Written Opinion for International Application No. PCT/US2015/010738, ISA/US, Alexandria, Virginia, United States, dated May 15, 2015, 13 pages.

Israel, E.J., et al., "Expression of the Neonatal Fc Receptor, FcRn, on Human Intestinal Epithelial Cells," Immunology 92(1):69-74, Blackwell Sciences, England (Sep. 1997).

International Preliminary Report on Patentability for No. PCT/US2015/010738, International Bureau of WIPO, Geneva, Switzerland, dated Jul. 12, 2016, 10 pages.

Kasuda, S., et al., "Establishment of Embryonic Stem Cells Secreting Human Factor VIII for Cell-based Treatment of Hemophilia A," Journal of Thrombosis and Haemostasis 6(8):1352-1359, International Society on Thrombosis and Haemostasis, England (Aug. 2008).

Kobayashi, N., et al., "FcRn-Mediated Transcytosis of Immunoglobulin G in Human Renal Proximal Tubular Epithelial Cells," American Journal of Physiology 282(2):F358-F365, American Physiological Society, United States (Feb. 2002).

Langner, K-D., et al., "Synthesis of Biologically Active Deletion Mutants of Human Factor VIII:C," Behring Institute Mitteilungen 82:16-25, Behringwerke AG, Germany (Apr. 1988).

Larrick, J.W., et al., "Rapid Cloning of Rearranged Immunoglobulin Genes from Human Hybridoma Cells using Mixed Primers and the Polymerase Chain Reaction," Biochemical and Biophysical Research Communications 160(3):1250-1256, Academic Press, United States (May 1989).

Lee, M.T, "Ch. 12: Disorders of Coagulation" in Pediatric Hematology Secrets, Weiner M.A. and Cario, M.S. eds., pp. 47-52, Hanley & Belfus, United States (2001).

(56) References Cited

OTHER PUBLICATIONS

Lenting, P.J., et al., "Clearance Mechanisms of Von Willebrand Factor and Factor VIII," Journal of Thrombosis and Haemostasis 5(7):1353-1360, International Society on Thrombosis and Haemostasis, England (Jul. 2007).
Lenting, P.J., et al., "The Life Cycle of Coagulation Factor VIII in view of its Structure and Function," Blood, 92(11):3983-3996, American Society of Hematology, United States (Dec. 1998).
Lillicrap, D., "Extending Half-life in Coagulation Factors: Where do We Stand?," Thrombosis Research, 122 Suppl 4:S2-S8, Pergamon Press, United States (2008).
Liu, T. et al., "Evaluation of Peg-FVIII Molecules with Prolonged Half-lives in a Murine FVIII-Dependent Bleeding Model," Journal of Thrombosis and Haemostasis 5(Suppl. 2): Abstract P-M-035, Abstracts from 2007 ISTH Congress, International Society on Thrombosis and Haemostasis, United States (2007).
Liu, T., et al., "Recombinant FVIII Fc Fusion Protein is Fully Active in Treating Acute Injury and Demonstrates Prolonged Prophylactic Efficacy in Hemophilia a Mice,"Journal of Thrombosis and Haemostasis 9(Suppl. 2):561, Abstract P-WE-131, Abstracts from 2011 ISTH Congress, International Society on Thrombosis and Haemostasis, United States (Jul. 2011).
Logan, J., et al., "Adenovirus Tripartite Leader Sequence Enhances Translation of mRNAs Late After Infection," Proceedings of the National Academy of Sciences USA 81(12):3655-3659, National Academy of Sciences, United States (Jun. 1984).
Mackett, M., et al., "General Method for Production and Selection of Infectious Vaccinia Virus Recombinants Expressing Foreign Genes," Journal of Virology 49(3):857-864, American Society for Microbiology, United States (Mar. 1984).
Mackett, M., et al., "Vaccinia Virus: A Selectable Eukaryotic Cloning and Expression Vector," Proceedings of the National Academy of Sciences USA 79(23):7415-7419, National Academy of Sciences, United States (Dec. 1982).
Mei, B., et al., "Expression of Human Coagulation Factor VIII in a Human Hybrid Cell Line, HKB11," Molecular Biotechnology 34(2):165-178, Humana Press Inc., United States (Oct. 2006).
Meloun, et al., "Complete Amino Acid Sequence of Human Serum Albumin," FEBS Letters:134-137, Wiley Online Library, United States (1975).
Meulien, P., et al., "A New Recombinant Procoagulant Protein Derived from the cDNA Encoding Human Factor VIII," Protein Engineering 2(4):301-306, IRL Press Ltd., England (Oct. 1988).
Miao, H.Z., et al., "Bioengineering of Coagulation Factor VIII for Improved Secretion," Blood 103(9):3412-3419, The American Society of Hematology, United States (May 2004).
Mount, J.D., et al., "Sustained Phenotypic Correction of Hemophilia B dogs with a Factor IX Null Mutation by Liver-directed Gene Therapy," Blood 99(8):2670-2676, The American Society of Hematology, United States (Apr. 2002).
Neumann, E., et al., "Gene Transfer into Mouse Lyoma Cells by Electroporation in High Electric Fields," The EMBO Journal 1(7):841-845, IRL Press Limited, England (Feb. 1982).
Panicali, D., et al., "Construction of Poxviruses as Cloning Vectors: Insertion of the Thymidine Kinase Gene from Herpes Simplex Virus into the DNA of Infectious Vaccinia Virus," Proceedings of the National Academy of Sciences USA 79(16):4927-4931, The National Academy of Sciences of the United States (Aug. 1982).
Pipe, S.W., et al., "Functional Factor VIII made with von Willebrand Factor at High Levels in Transgenic Milk," Journal of Thrombosis and Haemostasis 9(11):2235-2242, International Society on Thrombosis and Haemostasis, England (Nov. 2011).
Routledge, E.G., et al., "The Effect of Aglycosylation on the Immunogenicity of a Humanized Therapeutic CD3 Monoclonal Antibody," Transplantation 60(8):847-853, Lippincott Williams & Wilkins, United States (Oct. 1995).
Ruberti, F., et al., "The Use of the RACE Method to Clone Hybridoma cDNA when V Region Primers Fail," Journal of Immunological Methods 173(1):33-39, Elsevier, United States (Jul. 1994).

Ruther, U. and Muller-Hill, B., "Easy Identification of cDNA Clones," The EMBO Journal 2(10):1791-1794, IRL Press Ltd, England (1983).
Sarver, N., et al., "Stable Expression of Recombinant Factor VIII Molecules Using a Bovine Papillomavirus Vector," DNA 6(6):553-564, Mary Ann Liebert, Inc., United States (Dec. 1987).
Schellenberger, V., et al., "A Recombinant Polypeptide Extends the in Vivo Half-life of Peptides and Proteins in a Tunable Manner," Nature Biotechnology 27(12):1186-1190, Nature America, Inc., United States (Dec. 2009).
Shields, R.L., et al., "High Resolution Mapping of the Binding Site on Human IgG1 for Fc gamma RI, Fc gamma RII, Fc gamma RIII, and FcRn and Design of IgG1 Variants with Improved Binding to the Fc gamma R," The Journal of Biological Chemistry 276(9):6591-6604, American Society for Biochemistry and Molecular Biology, United States (Mar. 2001).
Simonsen, C.C., et al., "Isolation and Expression of an Altered Mouse Dihydrofolate Reductase cDNA," Proceedings of the National Academy of Sciences 80(9):2495-2499, National Academy of Sciences, United States (May 1983).
Smith, G.E., et al., "Molecular Engineering of the Autographa Californica Nuclear Polyhedrosis Virus Genome: Deletion Mutations within the Polyhedrin Gene," Journal of Virology 46(2):584-593, American Society for Microbiology, United States (May 1983).
Smith, T.F. and Waterman, M.S., "Comparison of Biosequences," Advances in Applied Mathematics 2(4):482-489, Academic Press, Inc., United States (Dec. 1981).
Story, C.M., et al., "A Major Histocompatibility Complex Class I-like Fc Receptor Cloned from Human Placenta: Possible Role in Transfer of Immunoglobulin G from Mother to Fetus," The Journal of Experimental Medicine 180(6):2377-2381, The Rockefeller University Press, United States (Dec. 1994).
Toole, J.J., et al., "A Large Region (95 kDa) of Human Factor VIII is Dispensable for in Vitro Procoagulant Activity," Proceedings of the National Academy of Sciences USA 83(16):5939-5942, National Academy of Sciences, United States (Aug. 1986).
Toole, J.J., et al., "Molecular Cloning of a cDNA Encoding Human Antihaemophilic Factor," Nature 312(5992):342-347, Nature Publishing Group, England (Nov. 1984).
Vehar, G.A., et al., "Structure of Human Factor VIII," Nature 312(5992):337-342, Nature Publishing Group, England (Nov. 1984).
Ward, E.S. and Ghetie, V., "The Effector Functions of Immunoglobulins: Implications for Therapy," Therapeutic Immunology 2(2):77-94, Blackwell Science Ltd., England (Apr. 1995).
Wigler, M., et al., "Biochemical Transfer of Single-copy Eucaryotic Genes using Total Cellular DNA as Donor," Cell 14(3):725-731, Cell Press, United States (Jul. 1978).
Wood, W.I., et al., "Expression of Active Human Factor VIII from Recombinant DNA Clones," Nature 312(5992):330-337, Nature Publishing Group, England (Nov. 1984).
Zhou, Y.F., et al., "Sequence and Structure Relationships within von Willebrand Factor," Blood 120(2):449-458, American Society of Hematology, United States (Jul. 2012).
Counts, R. B., et al., "Disulfide Bonds and the Quaternary Structure of Factor VIII/von Willebrand Factor," J. Clin. Invest. 62(3):702-09, The American Society for Clinical Investigation, Inc. (1978).
Thermo Scientific, "Instructions: Imidoester Crosslinkers: DMA, DMP, DMS, DTBP," available at https://tools.thermofisher.com/content/sfs/manuals/MAN0011314_ImidoesterCrsLnk_DMA_DMP_DMS_DTBP_UG.pdf, 2 pages (2012).
Nogami, K., et al., "A novel mechanism of factor VIII protection by von Willebrand factor from activated protein C—catalyzed inactivation," Blood 99(11):3993-98, American Society of Hematology (2002).
Nogami, K., et al., "Relationship between the binding sites for von Willebrand factor, phospholipid, and human factor VIII C2 inhibitor alloantibodies within the factor VIII C2 domain," Int. J. Hematol. 85(4):317-22, Springer (2007).
Li, X., et al., "The Physical Exchange of Factor VIII (FVIII) between von Willebrand factor and Activated Platelets and the Effect of the FVIII B-Domain on Platelet Binding," Biochemistry 36:10760-10767, Portland Press, United States (1997).

(56) References Cited

OTHER PUBLICATIONS

Woof, J.M., et al., "Human antibody-FC receptor interactions illuminated by crystal structures.," *Nat Rev Immunology* 4(2):89-99, Nature Publishing Group, United States (2004).
Heinz, S., et al., "Factor VIII-eGFP fusion proteins with preserved functional activity for the analysis of the early secretory pathway of factor VIII," *Thromb Haemost* 102: 925-935, Wiley-Blackwell, United States (2009).
Office Action dated May 30, 2017, in U.S. Appl. No. 14/379,192, inventor Ekta Seth Chhabra, filed Feb. 20, 2015.
Office Action dated Nov. 1, 2016, in U.S. Appl. No. 14/379,192, inventor Ekta Seth Chhabra, filed Feb. 20, 2015.
Office Action dated Sep. 27, 2017, in U.S. Appl. No. 14/379,192, inventor Ekta Seth Chhabra, filed Feb. 20, 2015.
Office Action dated Mar. 16, 2018, in U.S. Appl. No. 14/379,192 inventors Schellenberger et al., filed Feb. 20, 2015.
Office Action dated Aug. 7, 2018, in U.S. Appl. No. 14/379,192 inventors Schellenberger et al., filed Feb. 20, 2015.
Office Action dated May 17, 2017, in U.S. Appl. No. 14/371,948, inventor Ekta Seth Chhabra, filed Jul. 11, 2014.
Office Action dated Jun. 25, 2018, in U.S. Appl. No. 14/371,948 inventor Ekta Seth Chhabra, filed Jul. 11, 2014.
Office Action dated Dec. 12, 2017, in U.S. Appl. No. 14/371,948 inventor Ekta Seth Chhabra, filed Jul. 11, 2014.
Office Action dated May 23, 2017, in U.S. Appl. No. 14/894,108, inventor Ekta Seth Chhabra, filed May 3, 2016.
Office Action dated Dec. 15, 2017, in U.S. Appl. No. 14/894,108, inventor Ekta Seth Chhabra, filed May 3, 2016.
Office Action dated Sep. 25, 2017, in U.S. Appl. No. 14/379,196, inventor Kulman, J., et al., filed Aug. 15, 2014.
Office Action dated Apr. 30, 2018, in U.S. Appl. No. 14/379,196, inventor Kulman, J., et al., filed Aug. 15, 2014.
Office Action dated Sep. 5, 2018, in U.S. Appl. No. 14/379,196, inventor Kulman, J., et al., filed Aug. 15, 2014.
Office Action dated Jan. 26, 2018, in U.S. Appl. No. 14/895,264 inventor Ekta Seth Chhabra, filed Dec. 2, 2015.
Office Action dated Sep. 7, 2018, in U.S. Appl. No. 14/895,264 inventor Ekta Seth Chhabra, filed Dec. 2, 2015.
Office Action dated Jul. 21, 2017, in U.S. Appl. No. 14/413,765 inventor Ekta Seth Chhabra, filed Jan. 9, 2015.
Office Action dated Mar. 29, 2017, in U.S. Appl. No. 14/413,765 inventor Ekta Seth Chhabra, filed Jan. 9, 2015.
Leyte, A., et al., "Sulfation of Tyr1680 of human blood coagulation factor VIII is essential for the interaction of factor VIII with Von Willebrand Factor," *J Biol Chem* 266(2):740-746, American Society for Biochemistry and Molecular Biology, United States (1991).
Peters, R.T., et al., "Biochemical and functional characterization of a recombination monomeric factor VIII-fc fusion protein; Journal of thrombosis and haemostasis," *J. Thromb Haemost*.11(1):132-141, Wiley Online library, United States (2013).
Ngo, J, et al., "Crystal Structure of Human Factor VIII: Implications for the formation of the Factor IXa-Factor VIIIa complex," *Structure* 16: 597-606, Elsevier, Netherlands (2008).
Venkateswarlu, D., "Structural investigation of zymogenic and activated forms of human blood coagulation factor VIII: a computation molecular dynamics study," *BMC structural Biology* 10:7, BioMed Central, United Kingdom (2010).
Saenko, E. L., et al., "A Role for the C2 domain of factor VIII in binding to von Willebrand Factor," *Journal of Biological Chemistry* 269:11601-11605, American Society for Biochemistry and Molecular Biology, United States (1994).
Thompson, Arthur R., (2003) "Structure and function of the factor VIII gene and protein," *Semin Thromb Hemost.*, 29:11-22.
Caliceti, P., et al., "Biopharmaceutical Properties of Uricase Conjugated to Neutral and Amphiphilic Polymers," *Bioconjugate Chemistry* 10(4):638-646, American Chemical Society, United States (1999).
Cho, J.W. and Troy, F.A. II, "Polysialic Acid Engineering: Synthesis of Polysialylated Neoglycosphingolipids by Using the Polysialyltransferase from Neuroinvasive *Escherichia Coli* K1," Proceedings of the National Academy of Sciences USA 91 (24):11427-11431, National Academy of Sciences, United States (1994).
Delgado, C., et al., "The Uses and Properties of PEG-Linked Proteins," Critical Reviews in Therapeutic Drug Carrier Systems 9(3-4):249-304, CRC Press, Inc., United States (1992).
Dennis, M.S., et al., "Albumin Binding as a General Strategy for Improving the Pharmacokinetics of Proteins," The Journal of Biological Chemistry 277(38):35035-35043, American Society for Biochemistry and Molecular Biology, United States (2002).
Engels, et al., "Gene Synthesis," Angewandte Chemie International Edition, 28(6):716-734, VCH Verlagsgesellschaft mbH, Germany (1989).
GenBank, "*Homo Sapiens* Transferrin (TF), mRNA," Accession No. NM001063.3 published on May 25, 2014, accessed at http://www.ncbi.nlm.nih.gov/nuccore/NM_001063, accessed on Sep. 24, 2014, 5 pages.
GenBank, "*Homo Sapiens* Transferrin (TF), mRNA," Accession No. XM002793 published on May 13, 2002, accessed at https://www.ncbi.nlm.nih.gov/nuccore/XM_002793.7?report=genbank, accessed on Sep. 24, 2014, 2 pages.
GenBank, "*Homo Sapiens* Transferrin (TF), mRNA," Accession No. XM039847 published on Jul. 16, 2001, accessed at http://www.ncbi.nlm.nih.goV/nuccore/XM_039847.1?report=genbank, accessed on Sep. 24, 2014, 2 pages.
GenBank, "*Homo Sapiens* Transferrin (TF), mRNA," Accession No. XM039845 published Jul. 16, 2001, accessed at https://www.ncbi.nlm.nih.gov/nuccore/XM_039845.1?report=genbank, accessed on Sep. 24, 2014, 2 pages.
GenBank, "Human Transferrin mRNA, Complete cds," Accession No. M12530.1, published on Jan. 14, 1995, accessed at http://www.ncbi.nlm.nih.gov/nuccore/M1253014, accessed on Jan. 15, 2015, 2 pages.
GenBank, "Transferrin [human, liver, mRNA, 2347 nt]," Accession No. S95936.1, published on May 7, 1993, accessed at http://www.ncbi.nlm.nih.gov/nuccore/S95936, accessed on Sep. 24, 2014, 2 pages.
GenBank, "transferrin precursor [*Homo sapiens*]" Accession No. AAA61140.1, accessed at http://www.ncbi.nlm.nih.gov/protein/AAA61140, accessed on Mar. 29, 2016, 3 pages.
International Search Report and Written Opinion and Written Opinion for International Patent Application No. PCT/US2014/044718, United States Patent Office, Alexandria, Virginia, dated Nov. 4, 2014, 10 pages.
International Search Report and Written Opinion for International Application No. PCT/US2015/010738, ISA/US, Alexandria, Virginia, United States, dated May 15, 2015, 4 pages.
International Search Report and Written Opinion for International Patent Application No. PCT/US2013/021330, United States Patent Office, Alexandria, Virginia, dated Apr. 29, 2013, 4 pages.
International Search Report and Written Opinion for International Patent Application No. PCT/US2013/049989, United States Patent Office, Alexandria, Virginia, dated Dec. 16, 2013, 5 pages.
International Search Report and Written Opinion for International Patent Application No. PCT/US2014/044731, United States Patent Office, Alexandria, Virginia, dated Nov. 4, 2014, 4 pages.
Konig, T. and Skerra, A., "Use of an Albumin-Binding Domain for the Selective Immobilisation of Recombinant Capture Antibody Fragments on ELISA Plates," Journal of Immunological Methods 218(1-2):73-83, Elsevier Science B.V., Netherlands (1998).
Lenting, P.J., et al., "Clearance Mechanisms of Von Willebrand Factor and Factor VIII," Journal of Thrombosis and Haemostasis 5(7):1353-1360, International Society on Thrombosis and Haemostasis, England (2007).
Lenting, P.J., et al., "The Life Cycle of Coagulation Factor VIII in View of its Structure and Function," Blood, 92(11):3983-3996, American Society of Hematology, United States (1998).
McCue, J.T., et al., "Application of a Novel Affinity Adsorbent for the Capture and Purification of Recombinant Factor VIII Compounds," Journal of Chromatography A 1216(45):7824-7830, Elsevier, Netherlands (2009).
Morpurgo, M., et al., "Covalent Modification of Mushroom Tyrosinase with Different Amphiphic Polymers for Pharmaceutical and Biocatalysis

(56) References Cited

OTHER PUBLICATIONS

Applications," Applied Biochemistry and Biotechnology 56(1):59-72, Humana Press, Inc., United States (1996).
National Heart Lung and Blood Institute, "The Diagnosis, Evaluation and Management of von Willebrand Disease Scientific Overview," accessed at http://www.nhlbi.nih.gov/guidelines/vwd/2scientificoverview.htm, accessed on Oct. 22, 2011.
Newell et al., Acidic Residues C-terminal to the A2 domain Facilitate Thrombin-Catalyzed Activation of Factor VIII, Biochemistry, vol. 47:8786-8795 (2008).
Newell et al., Residues Surrounding Arg372, Arg740, and Arg1689 Contribute to the Rates of Thrombin-Catalyzed Cleavage of Factor VIII (Meeting Abstract), Blood, vol. 114(22):349 (Nov. 20, 2009).
Nieman, M.T., et al., "Interaction of thrombin with PAR1 and PAR4 at the thrombin cleavage site," Biochemistry 46(29):8603-8610, American Chemistry Society, United States (2007).
Office Action dated Jul. 21, 2017, in United States U.S. Appl. No. 14/413,765, inventor Ekta Seth Chhabra, filed Jul. 10, 2013.
Office Action dated Jun. 18, 2020, for U.S. Appl. No. 16/154,310, inventor Ekta Seth Chhabra, filed Oct. 8, 2018.
Office Action dated Mar. 9, 2020, for U.S. Appl. No. 14/371,948, inventor Ekta Seth Chhabra, filed Jul. 11, 2014.
Office Action dated May 17, 2019, for U.S. Appl. No. 14/894,108, inventor Ekta Seth Chhabra, filed May 3, 2016.
Office Action dated May 21, 2020, for U.S. Appl. No. 14/894,108, inventor Ekta Seth Chhabra, filed May 3, 2016.
Office Action dated Nov. 18, 2019, for U.S. Appl. No. 14/895,264, inventor Ekta Seth Chhabra, filed Dec. 2, 2015.
Office Action dated Sep. 19, 2019, for U.S. Appl. No. 14/371,948, inventor Ekta Seth Chhabra, filed Jul. 11, 2014.
Pool, J.G., et al., "Ineffectiveness of intramuscularly injected Factor 8 concentrate in two hemophilic patients," The New England Journal of Medicine 275(10):547-548, Massachusetts Medical Society, United States (1966).
Powell, J.S., et al., "Safety and Prolonged Activity of Recombinant Factor VIII Fc Fusion Protein in Hemophilia a Patients," Blood 119(13):3031-3037, The American Society of Hematology, United States (2012).
Proft, T., "Sortase-mediated protein ligation: an emerging biotechnology tool for protein modification and immobilization," Biotechnology Letters 32:1-10, Springer Science+Business Media B.V., Netherlands (Sep. 2009).
Roth, J. et al., "From Microbes to Man" in Polysialic Acid, Roth J., Rutishauser U., Troy F.A., eds., pp. 335-348, BirkhauserVerlag, Basel, Switzerland (1993).
Sambrook, J., et al., "Molecular Cloning: A Laboratory Manual," Second Edition, Cold Spring Harbor Laboratory Press, United States (1989).
Schlapschy, M., et al., "Fusion of a Recombinant Antibody Fragment with a Homo-amino-acid Polymer: Effects on Biophysical Properties and Prolonged Plasma Half-Life," Protein Engineering Design and Selection 20(6):273-284, Oxford University Press, England (2007).
Shen, B.W., et al., "The Tertiary Structure and Domain Organization of Coagulation Factor VIII," Blood 111 (3):1240-1247, The American Society of Hematology, United States (2008).
Sommermeyer, V.K., et al., "Klinisch Verwendete Hydroxyethylstarke: Physikalisch-Chemische Charakterisierung," Krankenhauspharmazie 8(8):271-278, Deutscher Apotheker Verlag, Birkenwaldstr, Germany (1987).
Terrarube et al., "Factor VIII and von Willebrand factor interaction: biological, clinical and therapeutic importance", Haemophilia(2010), vol. 16, pp. 3-13.
Vorobjev, P.E., et al., "Oligonucleotide Conjugated to Linear and Branched High Molecular Weight Polyethylene Glycol as Substrates for RNase H," Nucleosides & Nucleotides 18(11-12):2745-2750, Marcel Dekker, Inc., United States (1999).
Weidler, B., et al., "Pharmakokinetische Merkmale als Kriterien fur den klinischen Einsatz von Hydroxyethylstarke," Arzneimittel-Forschung 41(5):494-498, Editio Cantor, Germany (1991).
Donath et al., "Characterization of des-(741-1668)-factor VIII. A single-chain factor VIII variant with a fusion site susceptible to proteolysis by thrombin and factor Xa", Biochem J., 1995, 312: 49-55.
Extended European Search Report received for European Patent Application No. 15735473.9, dated Jun. 26, 2017, 9 Pages.
Extended European Search Report received for European Patent Application No. 14817900.5, dated Feb. 21, 2017, 10 Pages.
Final Office Action for U.S. Appl. No. 14/894,108, dated Sep. 25, 2020, 21 pages.
GenBank Database, Transferrin Precursor [*Homo sapiens*], Accession No. AAA61140.1, Retrieved from:«http://www.ncbi.nlm.nih.gov/protein/AAA61140.1», 1 Page, Jan. 14, 1995.
GenBank, Transferrin [Human, Liver, mRNA, 2347 nt], Accession No. S95936, Retrieved From:«http://www.ncbi.nlm.nih.gov/nuccore/S95936», 2 pages, May 7, 1993.
International Search Report and Written Opinion received for PCT Patent Application No. PCT/US2014/044731, dated Nov. 4, 2014, 11 Pages.
Non-Final Office Action for U.S. Appl. No. 14/894,108, dated Apr. 20, 2021, 23 pages.
Non-Final Office Action for U.S. Appl. No. 14/894,108, dated Dec. 12, 2018, 43 pages.
Notice of Allowance for U.S. Appl. No. 16/154,310, dated Mar. 25, 2021, 8 pages.
Sakata, "PAR-1 Thrombin Receptor Antagonist", Thrombosis Hemostasis Magazine, vol. 23, pp. 47-50. 2012.
Zhang, "Design Of FRET-Based GFP Probes for Detection Of Protease Inhibitors", Biochemical and Biophysical Research Communications, vol. 323, No. 2, pp. 674-678, Oct. 15, 2004.

\* cited by examiner

FVIII169/VWF057 - LVPR site in linker
FVIII169/VWF059 - a2 site in linker
FVIII169/VWF059a - truncated a2 site in linker
FVIII169/VWF073 - a2 fragment in linker ~312 kDa complex

FACTOR VIII CHIMERIC PROTEINS AND USES THEREOF

REFERENCE TO SEQUENCE LISTING SUBMITTED ELECTRONICALLY

The content of the electronically submitted sequence listing in ASCII text file (Name: 609332-SA9-448US-ST25.txt; Size: 820,853 bytes; Date of Creation: Jul. 15, 2020) is incorporated herein by reference in its entirety.

BACKGROUND OF THE INVENTION

Haemophilia A is a bleeding disorder caused by defects in the gene encoding coagulation factor VIII (FVIII) and affects 1-2 in 10,000 male births. Graw et al., *Nat. Rev. Genet.* 6(6): 488-501 (2005). Patients affected with hemophilia A can be treated with infusion of purified or recombinantly produced FVIII. All commercially available FVIII products, however, are known to have a half-life of about 8-12 hours, requiring frequent intravenous administration to the patients. See Weiner M. A. and Cairo, M. S., Pediatric Hematology Secrets, Lee, M. T., 12. Disorders of Coagulation, Elsevier Health Sciences, 2001; Lillicrap, D. Thromb. Res. 122 Suppl 4:S2-8 (2008). In addition, a number of approaches have been tried in order to extend the FVIII half-life. For example, the approaches in development to extend the half-life of clotting factors include pegylation, glycopegylation, and conjugation with albumin. See Dumont et al., Blood. 119(13): 3024-3030 (Published online Jan. 13, 2012). Regardless of the protein engineering used, however, the long acting FVIII products currently under development are reported to have limited half-lives—only to about 1.5 to 2 hours in preclinical animal models. See id. Consistent results have been demonstrated in humans, for example, rFVIIIFc was reported to improve half-life up to ~1.7 fold compared with ADVATE® in hemophilia A patients. See Id. Therefore, the half-life increases, despite minor improvements, may indicate the presence of other T1/2 limiting factors. See Liu, T. et al., 2007 ISTH meeting, abstract # P-M-035; Henrik, A. et al., 2011 ISTH meeting, abstract # P=MO-181; Liu, T. et al., 2011 ISTH meeting abstract # P-WE-131.

Plasma von Willebrand Factor (VWF) has a half-life of approximately 16 hours (ranging from 13 to 18 hours). Goudemand J, et al. *J Thromb Haemost* 2005; 3:2219-27. The VWF half-life may be affected by a number of factors: glycosylation pattern, ADAMTS-13 (a disintegrin and metalloprotease with thrombospondin motif-13), and various mutations in VWF.

In plasma, 95-98% of FVIII circulates in a tight noncovalent complex with full-length VWF. The formation of this complex is important for the maintenance of appropriate plasma levels of FVIII in vivo. Lenting et al., *Blood.* 92(11): 3983-96 (1998); Lenting et al., *J. Thromb. Haemost.* 5(7): 1353-60 (2007). The full-length wild-type FVIII is mostly present as a heterodimer having a heavy chain (MW 200 kD) and a light chain (MW 73 kD). When FVIII is activated due to proteolysis at positions 372 and 740 in the heavy chain and at position 1689 in the light chain, the VWF bound to FVIII is removed from the activated FVIII. The activated FVIII, together with activated factor IX, calcium, and phospholipid ("tenase complex"), induces the activation of factor X, generating large amounts of thrombin. Thrombin, in turn, then cleaves fibrinogen to form soluble fibrin monomers, which then spontaneously polymerize to form the soluble fibrin polymer. Thrombin also activates factor XIII, which, together with calcium, serves to crosslink and stabilize the soluble fibrin polymer, forming crosslinked (insoluble) fibrin. The activated FVIII is cleared fast from the circulation by proteolysis.

Due to the frequent dosing and inconvenience caused by the dosing schedule, there is still a need to develop FVIII products requiring less frequent administration, i.e., a FVIII product that has a half-life longer than the 1.5 to 2 fold half-life limitation.

BRIEF SUMMARY OF THE INVENTION

The present invention provides a chimeric protein comprising (i) a first polypeptide which comprises a Factor VIII ("FVIII") protein fused to a first immunoglobulin ("Ig") constant region or a portion thereof and (ii) a second polypeptide which comprises a von Willebrand Factor ("VWF") protein comprising a D' domain and a D3 domain of VWF fused to a second Ig constant region or a portion thereof by an XTEN sequence in-between, wherein the XTEN sequence contains less than 288 amino acid residues and wherein the first polypeptide is linked to or associated with the second polypeptide. Certain embodiments include the chimeric protein as described herein, wherein the XTEN sequence in the second polypeptide consists of an amino acid sequence having a length of between 12 amino acids and 287 amino acids.

Also disclosed is the chimeric protein as described herein, wherein the chimeric protein exhibits a longer half-life compared to a corresponding fusion protein comprising the first polypeptide and the second polypeptide wherein the second polypeptide of the fusion protein comprises an XTEN sequence containing at least 288 amino acids. Some embodiments include the XTEN sequence AE288, containing at least 288 amino acids. In some embodiments AE288 is SEQ ID NO: 8.

Also disclosed is the chimeric protein as described herein, wherein the XTEN sequence of the second polypeptide contains about 36, about 42, about 72, or about 144 amino acids. In some embodiments the XTEN sequence of the second polypeptide is selected from AE42, AE72, AE144, AG42, AG72, or AG144.

Some embodiments include the chimeric protein as described herein, wherein the XTEN sequence of the second polypeptide is selected from SEQ ID NO: 9, SEQ ID NO: 10, SEQ ID NO: 11, SEQ ID NO: 55; SEQ ID NO: 56; SEQ ID NO: 57; SEQ ID NO: 58; SEQ ID NO: 58; SEQ ID NO: 59; SEQ ID NO: 14; SEQ ID NO: 60; SEQ ID NO: 61; SEQ ID NO: 62; or SEQ ID NO: 63.

In certain embodiments the first polypeptide further comprises a second XTEN sequence which links the FVIII protein with the first Ig constant region or a portion thereof. Also disclosed is the chimeric protein as described herein, wherein the first polypeptide comprises a third XTEN sequence which is inserted at one or more insertion sites within the FVIII protein. In some embodiments the first polypeptide further comprises a second XTEN sequence which is inserted at one or more insertion sites within the FVIII protein. In certain embodiments, the first polypeptide comprises a third XTEN sequence which links the FVIII protein with the first Ig constant region or a portion thereof.

Also disclosed is the chimeric protein as described herein, wherein the second XTEN sequence, the third XTEN sequence, or the second and third XTEN sequences are each independently selected from AE42, AE72, AE864, AE576, AE288, AE144, AG864, AG576, AG288, and AG144. In some embodiments the second XTEN sequence, the third XTEN sequence, or the second and third XTEN sequences are each independently selected from SEQ ID NO: 8; SEQ ID NO: 9, SEQ ID NO: 10, SEQ ID NO: 11, SEQ ID NO: 17; SEQ ID NO: 54; SEQ ID NO: 19; SEQ ID NO: 16; SEQ ID NO: 18; SEQ ID NO: 15; SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63. In certain embodiments the second XTEN sequence, the third XTEN sequence, or both the second and third XTEN sequences are each independently AE288 or AG288. In some embodiments the XTEN sequence in the second polypeptide is fused to the second Ig constant region or a portion thereof by a linker. In certain embodiments the linker is a cleavable linker.

Some embodiments include the chimeric protein as described herein, wherein the linker is cleavable by a protease selected from factor XIa, factor XIIa, kallikrein, factor VIIa, factor IXa, factor Xa, factor IIa (thrombin), Elastase-2, Granzyme-B, TEV, Enterokinase, Protease 3C, Sortase A, MMP-12, MMP-13, MMP-17, and MMP-20. In some embodiments the linker is cleavable by factor IIa (thrombin).

Also disclosed is the chimeric protein as described herein, wherein the linker comprises one or more cleavage sites comprising an amino acid sequence selected from RRRR (SEQ ID NO: 102), RKRRKR (SEQ ID NO: 103), RRRRS (SEQ ID NO: 104), TQSFNDFTR (SEQ ID NO: 1), SVSQTSKLTR (SEQ ID NO: 3), DFLAEGGGVR (SEQ ID NO: 4), TTKIKPR (SEQ ID NO: 5), LVPRG (SEQ ID NO: 6), ALRPR (SEQ ID NO: 7), KLTRAET (SEQ ID NO: 121), DFTRVVG (SEQ ID NO: 122), TMTRIVGG (SEQ ID NO: 123), SPFRSTGG (SEQ ID NO: 124), LQVRIVGG (SEQ ID NO: 125), PLGRIVGG (SEQ ID NO: 126), IEGRTVGG (SEQ ID NO: 127), LTPRSLLV (SEQ ID NO: 128), LGPVSGVP (SEQ ID NO: 129), VAGDSLEE (SEQ ID NO: 130), GPAGLGGA (SEQ ID NO: 131), GPAGLRGA (SEQ ID NO: 132), APLGLRLR (SEQ ID NO: 133), PALPLVAQ (SEQ ID NO: 134), ENLYFQG (SEQ ID NO: 135), DDD-KIVGG (SEQ ID NO: 136), LEVLFQGP (SEQ ID NO: 137), LPKTGSES (SEQ ID NO: 138), DKNTGDYYED-SYEDISAYLLSKNNAIEPRSFS (SEQ ID NO: 88), and IEPRSFS (SEQ ID NO: 194). In some embodiments the linker comprises TLDPRSFLLRNPNDKYEPFWEDEEK (SEQ ID NO: 146). In certain embodiments the cleavage sites comprise an amino acid sequence of LVPRG (SEQ ID NO:6). In other embodiments the cleavage site comprises an amino acid sequence of IEPRSFS (SEQ ID NO: 194). In still other embodiments the cleavage site comprises an amino acid sequence of IEPRSFS (SEQ ID NO: 194), wherein the cleavage site is not the full length a2 region of FVIII. In some embodiments, the cleavage site comprises a fragment of an a2 region of FVIII comprising at least the sequence IEPR (SEQ ID NO: 200). In other embodiments, the cleavage site comprises a fragment of an a2 region of FVIII comprising at least the sequence IEPR (SEQ ID NO: 200), wherein the cleavage site is not the full length a2 region. In certain embodiments, the cleavage site is cleavable in a thrombin cleavage assay as provided herein or as known in the art.

Some embodiments include the chimeric protein as described herein, wherein the first Ig constant region or a portion thereof comprises a first Fc region and/or the second Ig constant region or a portion thereof comprises a second Fc region. In some embodiments the first Ig constant region or a portion thereof and the second Ig constant region or a portion thereof extend the half-life of the chimeric protein. In some embodiments the first polypeptide and the second polypeptide is fused by a linker. In certain embodiments the first polypeptide and the second polypeptide is fused by a processable linker. In some embodiments the first Ig constant region or a portion thereof is associated with the second Ig constant region or a portion thereof. In certain embodiments the first Ig constant region or a portion thereof is associated with the second Ig constant region or a portion thereof by a covalent bond. In some embodiments the covalent bond is a disulfide bond.

Also disclosed is the chimeric protein comprising each of the following formulae (a)-(hh):
(a) FVIII-F1:F2-L2-X-L1-V;
(b) FVIII-F1:V-L1-X-L2-F2;
(c) F1-FVIII:F2-L2-X-L1-V;
(d) F1-FVIII:V-L1-X-L2-F2;
(e) FVIII-X2-F1:F2-L2-X1-L1-V;
(f) FVIII-X2-F1:V-L1-X1-L2-F2;
(g) FVIII(X2)-F1:F2-L2-X1-L1-V;
(h) FVIII(X2)-F1:V-L1-X1-L2-F2;
(i) F1-X2-F1:F2-L2-X1-L1-V;
(j) F1-X2-F1:V-L1-X1-L2-F2;
(k) V-L1-X-L2-F2-L3-FVIII-L4-F1;
(l) V-L1-X-L2-F2-L3-F1-L4-FVIII;
(m) F1-L4-FVIII-L3-F2-L2-X-L1-V;
(n) FVIII-L4-F1-L3-F2-L2-X-L1-V;
(o) FVIII-L4-F1-L3-V-L1-X-L2-F2;
(p) FVIII-L4-F1-L3-F2-L2-X-L1-V;
(q) F2-L2-X-L1-V-L3-F1-L4-FVIII;
(r) F2-L2-X-L1-V-L3-FVIII-L4-F1;
(s) V-L1-X1-L2-F2-L3-FVIII(X2)-L4-F1;
(t) V-L1-X1-L2-F2-L3-F1-L4-FVIII(X2);
(u) F1-L4-FVIII(X2)-L3-F2-L2-X1-L1-V;
(v) F-L4-FVIII(X2)-L3-V-L1-X1-L2-F2;
(w) FVIII(X2)-L4-F1-L3-V-L1-X1-L2-F2;
(x) FVIII(X2)-L4-F1-L3-F2-L2-X1-L1-V;
(y) F2-L2-X1-L1-V-L3-F1-L4-FVIII(X2);
(z) F2-L2-X1-L1-V-L3-FVIII(X2)-L4-F1;
(aa) V-L1-X2-L2-F2-L3-FVIII-L4-X2-L5-F1;
(bb) V-L1-X2-L2-F2-L3-F1-L5-X2-L4-FVIII;
(cc) F1-L5-X2-L4-FVIII-L3-F2-L2-X2-L1-V;
(dd) F1-L5-X2-L4-FVIII-L3-V-L1-X2-L2-F2;
(ee) FVIII-L5-X2-L4-F2-L3-V-L1-X1-L2-F1;
(ff) FVIII-L5-X2-L4-F2-L3-F1-L2-X1-L1-V;
(gg) F1-L2-X1-L1-V-L3-F2-L4-X2-L5-FVIII; or
(hh) F1-L2-X1-L1-V-L3-FVIII-L5-X2-L4-F2;
wherein V is a VWF protein, which comprises a D' domain and a D3 domain, X or X1 is a first XTEN sequence that contains less than 288 amino acids, X2 is a second XTEN sequence, FVIII comprises a FVIII protein, FVIII(X2) comprises a FVIII protein having a second XTEN sequence inserted in one or more insertion sites within the FVIII protein, F1 is a first Ig constant region or a portion thereof, F2 is a second Ig constant region or a portion thereof, L1, L2, L3, L4, or L5 is an optional linker, (-) is a peptide bond; and (:) is a covalent bond or a non-covalent bond.

Some embodiments include the chimeric protein as described herein, wherein the X or X1 consists of an amino acid sequence in length between 12 amino acids and 287 amino acids.

In certain embodiments the chimeric protein as described herein exhibits a longer half-life compared to a corresponding chimeric protein comprising the formula except that the X or X1 is AE288. In some embodiments AE288 is SEQ ID NO:8.

Some embodiments include the chimeric protein as described herein, wherein the X or X1 in the formula contains about 36, about 42, about 72, or about 144 amino acids. In certain embodiments the X or X1 in the formula is selected from AE42, AE72, AE144, AG42, AG72, or AG144. In some embodiments the X or X1 in the formula is selected from SEQ ID NO: 9, SEQ ID NO: 10, SEQ ID NO: 11, SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63. In certain embodiments the X2 comprises an amino acid sequence having a length of at least about 36 amino acids, at least about 42 amino acids, at least about 144 amino acids, at least about 288 amino acids, at least about 576 amino acids, at least about 864 amino acids. In certain embodiments the X2 is selected from AE42, AE72, AE864, AE576, AE288, AE144, AG864, AG576, AG288, and AG144. In some embodiments the X2 is selected from SEQ ID NO: 8; SEQ ID NO: 9; SEQ ID NO: 10; SEQ ID NO: 11; SEQ ID NO: 17; SEQ ID NO: 54; SEQ ID NO: 19; SEQ ID NO: 16; SEQ ID NO: 18; SEQ ID NO: 15; SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63. In certain embodiments the X2 is AE288 or AG288.

Also disclosed is the chimeric protein as described herein, comprising X or X1 and/or X2 that exhibits a longer half-life compared to the chimeric protein not comprising X or X1 and/or X2. In some embodiments, the L1 and/or L2 is a cleavable linker. In certain embodiments the L4 and/or L5 is a cleavable linker. In certain embodiments the linker is cleavable by a protease selected from factor XIa, factor XIIa, kallikrein, factor VIIa, factor IXa, factor Xa, factor IIa (thrombin), Elastase-2, Granzyme-B, TEV, Enterokinase, Protease 3C, Sortase A, MMP-12, MMP-13, MMP-17, and MMP-20. In some embodiments the linker is cleavable by factor IIa (thrombin).

Some embodiments include the chimeric protein as described herein, wherein the linker comprises one or more cleavage sites comprising an amino acid sequence selected from RRRR (SEQ ID NO: 102), RKRRKR (SEQ ID NO: 103), RRRRS (SEQ ID NO: 104), TQSFNDFTR (SEQ ID NO: 1), SVSQTSKLTR (SEQ ID NO: 3), DFLAEGGGVR (SEQ ID NO: 4), TTKIKPR (SEQ ID NO: 5), LVPRG (SEQ ID NO: 6), ALRPR (SEQ ID NO: 7), KLTRAET (SEQ ID NO: 121), DFTRWG (SEQ ID NO: 122), TMTRIVGG (SEQ ID NO: 123), SPFRSTGG (SEQ ID NO: 124), LQVRIVGG (SEQ ID NO: 125), PLGRIVGG (SEQ ID NO: 126), IEGRTVGG (SEQ ID NO: 127), LTPRSLLV (SEQ ID NO: 128), LGPVSGVP (SEQ ID NO: 129), VAGDSLEE (SEQ ID NO: 130), GPAGLGGA (SEQ ID NO: 131), GPAGLRGA (SEQ ID NO: 132), APLGLRLR (SEQ ID NO: 133), PALPLVAQ (SEQ ID NO: 134), ENLYFQG (SEQ ID NO: 135), DDDKIVGG (SEQ ID NO: 136), LEVLFQGP (SEQ ID NO: 137), and LPKTGSES (SEQ ID NO: 138). In some embodiments the linker comprises TLDPRSFLLRNPNDKYEPFWEDEEK (SEQ ID NO: 146). In certain embodiments the linker comprises an amino acid sequence of LVPRG (SEQ ID NO: 6). In some embodiments the linker comprises an a1 region of FVIII, an a2 region of FVIII, an a3 region of FVIII, or any combination thereof. In certain embodiments the linker comprises a fragment of the a2 region of FVIII. The fragment of the a2 region can in some cases comprise the sequence DKNTGDYYEDSYEDISAYLLSKNNAIEPRSFS (SEQ ID NO: 88). In still other embodiments a smaller fragment of the a2 region of FVIII can be used, including a fragment having the sequence of IEPRSFS (SEQ ID NO: 194). In one particular embodiment, the linker comprises the amino acid sequence of IEPRSFS (SEQ ID NO: 194). In another embodiment, the linker comprises the amino acid sequence of IEPRSFS (SEQ ID NO: 194), wherein the linker is not the full-length a2 region of FVIII.

Also disclosed is the chimeric protein as described herein, wherein the a2 region of FVIII comprises an amino acid sequence at least about 80%, about 85%, about 90%, about 95%, or 100% identical to either ISDKNTGDYYEDSYE-DISAYLLSKNNAIEPRSFS (SEQ ID NO: 106) or DKNTGDYYEDSYEDISAYLLSKNNAIEPRSFS (SEQ ID NO: 88). In some embodiments the a1 region comprises an amino acid sequence at least about 80%, about 85%, about 90%, about 95%, or 100% identical to ISMKNNEE-AEDYDDDLTDSEMDVVRFDDDNSPSFIQIRSV (SEQ ID NO: 107). In certain embodiments the a3 region comprises an amino acid sequence at least about 80%, about 85%, about 90%, about 95%, or 100% identical to ISEITRT-TLQSDQEEIDYDDTISVEMKKEDFDIYD-EDENQSPRSFQ (SEQ ID NO: 108). In some embodiments the F1 comprises a first Fc region and/or the F2 comprises a second Fc region.

Some embodiments include the chimeric protein as described herein, wherein the chimeric protein comprising the F1 and the F2 exhibits a longer half-life compared to the chimeric protein not comparing the F1 and the F2. In certain embodiments the L3 is a processable linker. In some embodiments the VWF protein is associated with the FVIII protein by a non-covalent bond. In some embodiments the half-life of the chimeric protein is extended compared to a FVIII protein without the VWF protein and/or the XTEN sequence or compared to wild type FVIII. In certain embodiments the half-life of the chimeric protein is extended at least about 1.5 times, at least about 2 times, at least about 2.5 times, at least about 3 times, at least about 4 times, at least about 5 times, at least about 6 times, at least about 7 times, at least about 8 times, at least about 9 times, at least about 10 times, at least about 11 times, or at least about 12 times longer than a FVIII protein without the VWF protein or the XTEN sequence or than wild type FVIII.

Also disclosed is the chimeric protein as described herein, wherein the half-life of the chimeric protein is at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 48 hours, at least about 60 hours, at least about 72 hours, at least about 84 hours, at least about 96 hours, or at least about 108 hours. In some embodiments the half-life of the chimeric protein is about 40 hours in HemA mice. In certain embodiments the VWF protein does not bind substantially to a VWF clearance receptor. In some embodiments the VWF protein is capable of protecting the FVIII protein from one or more protease cleavages, protecting the FVIII protein from activation, stabilizing the heavy chain and/or the light chain of the FVIII protein, or preventing clearance of the FVIII protein by one or more scavenger receptors.

Some embodiments include the chimeric protein as described herein, wherein the VWF protein inhibits or prevents endogenous VWF from binding to the FVIII protein by shielding or blocking a VWF binding site on the FVIII protein. In certain embodiments the VWF binding site is located in the A3 domain or the C2 domain of the FVIII protein or both the A3 domain and the C2 domain. In some embodiments the VWF binding site comprises the amino acid sequence corresponding to amino acids 1669 to 1689 and 2303 to 2332 of SEQ ID NO: 65. In some embodiments the first Ig constant region or a portion thereof and the second Ig constant region or a portion thereof are identical or different. In certain embodiments the FVIII protein is linked to and/or inserted with at least two XTEN sequences, at least three XTEN sequences, at least four XTEN sequences, at least five XTEN sequences, or at least six XTEN sequences.

Also disclosed is the chimeric protein as described herein, wherein the FVIII protein comprises one or more domains of FVIII selected from an A1 domain, a1 acidic region, an A2 domain, a2 acidic region, a B domain, an A3 domain, a3 acidic region, a C1 domain, a C2 domain, one or more fragments thereof, and any combinations thereof.

Also disclosed is the chimeric protein as described herein, wherein the one or more insertion sites in the FVIII protein is located within one or more domains of the FVIII protein selected from the A1 domain, the a1 acidic region, the A2 domain, the a2 acidic region, the A3 domain, the B domain, the C1 domain, the C2 domain, and any combinations thereof or between one or more domains of the FVIII protein selected from the group consisting of the A1 domain and a1 acidic region, the a1 acidic region and A2 domain, the A2 domain and a2 acidic region, the a2 acidic region and B domain, the B domain and A3 domain, the A3 domain and C1 domain, the C1 domain and C2 domain, and any combinations thereof or between two domains of the FVIII protein selected from the A1 domain and a1 acidic region, the a1 acidic region and A2 domain, the A2 domain and a2 acidic region, the a2 acidic region and B domain, the B domain and A3 domain, the A3 domain and C1 domain, the C1 domain and C2 domain, and any combinations thereof. In some embodiments the one or more insertion sites in the FVIII protein are one or more amino acids selected from the group consisting of the amino acid residues in Table 7, Table 8, Table 9 and Table 10. In certain embodiments the insertion sites in the FVIII protein are located immediately downstream of amino acid 745 corresponding to the mature FVIII protein (SEQ ID NO: 65). In some embodiments the insertion sites in the FVIII protein are located immediately downstream of residue 1656 and residue 1900 corresponding to the mature FVIII protein (SEQ ID NO: 65). In some embodiments the insertion sites in the FVIII protein are immediately downstream of residues 26, 1656, and 1900 corresponding to the mature FVIII protein (SEQ ID NO: 65). In certain embodiments the insertion sites in the FVIII protein are immediately downstream of residues 403 and 745 corresponding to the mature FVIII protein (SEQ ID NO: 65). In some embodiments the insertion sites in the FVIII protein are immediately downstream of residues 745 and 1900 corresponding to the mature FVIII protein (SEQ ID NO: 65). In certain embodiments the insertion sites in the FVIII protein are immediately downstream of residues 18 and 745 corresponding to the mature FVIII protein (SEQ ID NO: 65). In some embodiments the FVIII protein is a dual chain FVIII isoform. In some embodiments the FVIII protein is a single chain FVIII isoform. In certain embodiments the FVIII protein comprises B domain or a portion thereof. In some embodiments the FVIII protein is SQ B domain deleted FVIII.

Some embodiments include the chimeric protein as described herein, wherein the single chain FVIII isoform contains at least one amino acid substitution at a residue corresponding to residue 1648, residue 1645, or both residues corresponding to the full-length mature Factor VIII polypeptide (SEQ ID NO: 65) or residue 754, residue 751, or both residues of SQ BDD Factor VIII (SEQ ID NO: 67). In certain embodiments the amino acid substitution is an amino acid other than arginine. In some embodiments the dual chain FVIII isoform comprises a first chain comprising a heavy chain of FVIII and a second chain comprising a light chain of FVIII, wherein the heavy chain and the light chain are associated with each other by a metal bond. In certain embodiments the D' domain comprises an amino acid sequence at least 90%, 95%, 96%, 97%, 98%, 99%, or 100% identical to amino acids 764 to 866 of SEQ ID NO: 21. In some embodiments the D3 domain comprises an amino acid sequence at least 90%, 95%, 96%, 97%, 98%, 99%, or 100% identical to amino acids 867 to 1240 of SEQ ID NO: 21. In certain embodiments the VWF protein is a monomer.

Also disclosed is the chimeric protein as described herein, which comprises at least two VWF proteins, at least three VWF proteins, at least four VWF proteins, at least five VWF proteins, or at least six VWF proteins. In certain embodiments the VWF protein comprises an amino acid sequence at least 90%, 95%, 96%, 97%, 98%, 99%, or 100% identical to amino acids 764 to 1240 of SEQ ID NO: 21. In some embodiments the VWF protein consists essentially of or consists of amino acids 764 to 1240 of SEQ ID NO: 21. In certain embodiments the VWF protein contains at least one amino acid substitution at a residue corresponding to residue 1099, residue 1142, or both residues 1099 and 1142 of SEQ ID NO: 21. In some embodiments the VWF protein contains an amino acid other than cysteine substituted for a residue corresponding to residue 1099, residue 1142, or both residues 1099 and 1142 of SEQ ID NO: 21. In certain embodiments the VWF protein further comprises the D1 domain, the D2 domain, or the D1 and D2 domains of VWF.

Some embodiments include the chimeric protein as described herein, wherein the VWF protein further comprises a VWF domain selected from the A1 domain, the A2 domain, the A3 domain, the D4 domain, the B1 domain, the B2 domain, the B3 domain, the C1 domain, the C2 domain, the CK domain, one or more fragments thereof, and any combinations thereof.

Also disclosed is the chimeric protein as described herein, wherein the VWF protein consists essentially of or consists of: (1) the D' and D3 domains of VWF or fragments thereof; (2) the D1, D', and D3 domains of VWF or fragments thereof; (3) the D2, D', and D3 domains of VWF or fragments thereof; (4) the D1, D2, D', and D3 domains of VWF or fragments thereof; or (5) the D1, D2, D', D3, and A1 domains of VWF or fragments thereof.

Some embodiments include the chimeric protein as described herein, wherein the VWF protein further comprises a signal peptide of VWF or FVIII which is operably linked to the VWF protein.

Also disclosed is the chimeric protein as described herein, wherein one or more of the linkers have a length of at least about 10, 20, 30, 40, 50, 60, 70, 80, 90, 100, 110, 120, 130, 140, 150, 160, 170, 180, 190, 200, 210, 220, 230, 240, 250, 300, 350, 400, 450, 500, 550, 600, 650, 700, 750, 800, 850, 900, 950, 1000, 1200, 1400, 1600, 1800, or 2000 amino acid residues. In some embodiments one or more of the linkers have a length of about 1 to about 2000 amino acid residues. In certain embodiments one or more of the linkers comprise a gly/ser peptide. In some embodiments the gly/ser peptide has a formula of $(Gly_4Ser)_n$ (SEQ ID NO: 94) or $S(Gly_4Ser)_n$ (SEQ ID NO: 164), wherein n is a positive integer selected from the group consisting of 1, 2, 3, 4, 5, 6, 7, 8, 9 and 10. In certain embodiments the $(Gly_4Ser)_n$ linker is $(Gly_4Ser)_3$ (SEQ ID NO: 100) or $(Gly_4Ser)_4$ (SEQ ID NO: 165). In some embodiments the linker comprises 20 amino acids, 35 amino acids, 48 amino acids, 73 amino acids, or 95 amino acids. In certain embodiments the cleavable linker is SGGGGSGGGGSGGGGSGGGGSGGGGSLVPRGSGG (SEQ ID NO: 166).

In some embodiments, the chimeric protein as described herein is polysialylated, pegylated, or hesylated.

Also disclosed is the chimeric protein as described herein, wherein the first polypeptide comprises at least about 80%, 90%, 95%, 99%, or 100% identical to FVIII161 (SEQ ID NO: 69), FVIII169 (SEQ ID NO: 70), FVIII173 (SEQ ID NO: 72), FVIII195 (SEQ ID NO: 73), FVIII196 (SEQ ID NO: 74), FVIII199 (SEQ ID NO: 75), FVIII201 (SEQ ID NO: 76), FVIII203 (SEQ ID NO: 77), FVIII204 (SEQ ID NO: 78), FVIII205 (SEQ ID NO: 79), FVIII266 (SEQ ID NO: 80), FVIII267 (SEQ ID NO: 81), FVIII268 (SEQ ID NO: 82), FVIII269 (SEQ ID NO: 83), FVIII271 (SEQ ID NO: 84), FVIII272 (SEQ ID NO: 85), or FVIII282 (SEQ ID NO: 159), and the second polypeptide comprises at least about 80%, 90%, 95%, 99%, or 100% identical to either VWF057 (SEQ ID NO: 152) or VWF059 (SEQ ID NO: 197). In some embodiments, the first polypeptide comprises FVIII169 (SEQ ID NO: 70) and the second polypeptide comprises VWF057 (SEQ ID NO: 152). In other embodiments, the first polypeptide comprises FVIII169 (SEQ ID NO: 70) and the second polypeptide comprises VWF059 (SEQ ID NO: 197). In yet another embodiment, the first polypeptide comprises FVIII169 (SEQ ID NO: 70) and the second polypeptide comprises VWF062 (SEQ ID NO: 199). In some embodiments, the chimeric protein is efficacious in preventing and/or stopping bleeding from a subject in need thereof.

Also disclosed is a polynucleotide or a set of polynucleotides encoding the chimeric protein as described herein. In some embodiments, the polynucleotide as described herein, further comprises a polynucleotide chain, which encodes PC5 or PC7.

Some embodiments include a vector comprising the polynucleotide as described herein and one or more promoter operably linked to the polynucleotide or the set of polynucleotides.

In some embodiments the vector as described herein, further comprises an additional vector, which comprises a polynucleotide chain encoding PC5 or PC7.

Also disclosed is a host cell comprising the polynucleotide or the vector as described herein. In some embodiments the host cell is a mammalian cell. In certain embodiments the mammalian cell is selected from HEK293 cell, CHO cell, and BHK cell.

Also disclosed is a pharmaceutical composition comprising the chimeric protein, the polynucleotide, the vector, or the host cell as described herein, and a pharmaceutically acceptable carrier. In some embodiments the chimeric protein has extended half-life compared to wild type FVIII protein. In certain embodiments, the half-life of the chimeric protein is extended at least about 1.5 times, at least about 2 times, at least about 2.5 times, at least about 3 times, at least about 4 times, at least about 5 times, at least about 6 times, at least about 7 times, at least about 8 times, at least about 9 times, at least about 10 times, at least about 11 times, or at least about 12 times longer than wild type FVIII.

Some embodiments include the composition as described herein, wherein the half-life of the chimeric protein is at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 48 hours, at least about 60 hours, at least about 72 hours, at least about 84 hours, at least about 96 hours, or at least about 108 hours. In certain embodiments the half-life of the chimeric protein is about 40 hours in HemA mice. In some embodiments the composition as described herein is administered by a route selected from the group consisting of topical administration, intraocular administration, parenteral administration, intrathecal administration, subdural administration and oral administration. In certain embodiments the parenteral administration is intravenous or subcutaneous administration.

In some embodiments the composition as described herein is used to treat a bleeding disease or condition in a subject in need thereof. In certain embodiments the bleeding disease or condition is selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, bleeding in the illiopsoas sheath and any combinations thereof. In some embodiments the subject is scheduled to undergo a surgery. In certain embodiments the treatment is prophylactic or on-demand.

Also disclosed is a method of extending or increasing half-life of the chimeric protein, wherein the method comprises adding an effective amount of the chimeric protein, the polynucleotide, the vector, the host cell, or the composition as described herein to a subject in need thereof, wherein the VWF protein, the XTEN sequence, the first Ig constant region or a portion thereof, and the second Ig constant region or a portion thereof increase the half-life of the chimeric protein.

Some embodiments include a method of treating a bleeding disease or disorder in a subject in need thereof comprising administering an effective amount of the chimeric protein, the polynucleotide, the vector, the host cell, or the composition as described herein, wherein the bleeding disease or disorder is selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath. In some embodiments the subject is an animal. In certain embodiments the animal is a human. In some embodiments the subject is suffering from hemophilia A. In certain embodiments the treatment is prophylactic or on-demand. In some embodiments the effective amount is 0.1 µg/kg to 500 mg/kg.

Also disclosed is a method as described herein, wherein the chimeric protein, the polynucleotide, the vector, the host cell, or the composition as described herein is administered by a route selected from the group consisting of topical administration, intraocular administration, parenteral administration, intrathecal administration, subdural administration and oral administration. In certain embodiments the parenteral administration is selected from the group consisting of intravenous administration, subcutaneous administration, intramuscular administration, and intradermal administration.

Some embodiments include a method of making a chimeric protein, comprising transfecting one or more host cell with the polynucleotide or the vector as described herein and expressing the chimeric protein in the host cell. In some embodiments, the method as described herein further comprises isolating the chimeric protein. In certain embodiments the chimeric protein is efficacious in stopping and/or preventing bleeding in the subject.

BRIEF DESCRIPTION OF THE DRAWINGS/FIGURES

FIG. 1 shows a schematic diagram of a chimeric protein comprising a first polypeptide which comprises a FVIII protein (A1-A2-partial or full B-A3-C1-C2) fused to an Fc region, wherein an XTEN is inserted at an insertion site within the FVIII protein and a second polypeptide which comprises a VWF protein comprising D'D3 domains, an XTEN having less than 288 amino acids, a thrombin cleavable linker, and a second Fc region. XTEN insertions in the FVIII protein and/or fusions to the VWF protein extend a half-life of the chimeric protein by increasing the hydrodynamic radius and by blocking receptor-mediated clearance. The D'D3 domains of VWF block FVIII interaction with endogenous VWF, stabilize the FVIII protein, and extend a half-life of the chimeric protein. The Fc domains can covalently link the D'D3 domains with the FVIII protein and extend a half-life of the chimeric protein through FcRn-mediated recycling pathway. The thrombin-cleavable linker enables a release of the D'D3 domains upon FVIII activation and ensures the correct alignment between FVIII and the D'D3 domains of VWF.

Figure 2:
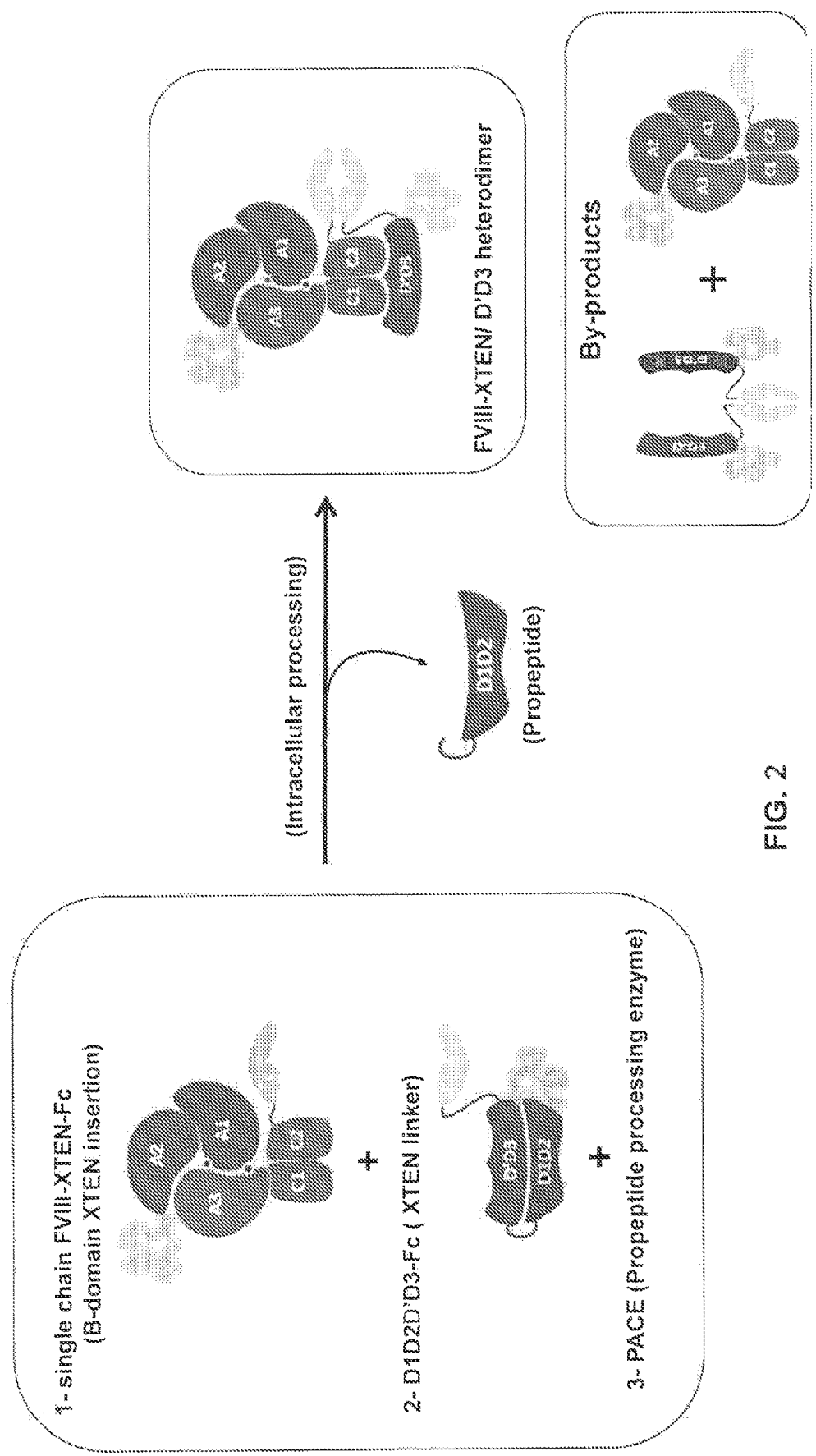

FIG. 2 shows three plasmid expression system for FVIII-XTEN-Fc:D'D3-XTEN-Fc heterodimers: a first plasmid comprising a nucleotide sequence encoding single chain FVIII-XTEN-Fc in which an XTEN is inserted in the B domain; a second plasmid comprising a nucleotide sequence encoding D1D2D'D3-XTEN-Fc, in which the XTEN sequence comprises less than 288 amino acids; and a third plasmid comprising a nucleotide sequence encoding PACE, a propeptide processing enzyme. When the three polypeptides are expressed from the three plasmids, the D1D2 propeptide domains of VWF can be processed from the D'D3 domains by intracellular processing. The resulting complex contains three products, the first molecule being FVIII-XTEN/D'D3 heterodimers, the second molecule being a by-product, homodimer of D'D3-XTEN-Fc, and the third molecule being another by-product, i.e., FVIII (XTEN)-Fc.

Figure 3:
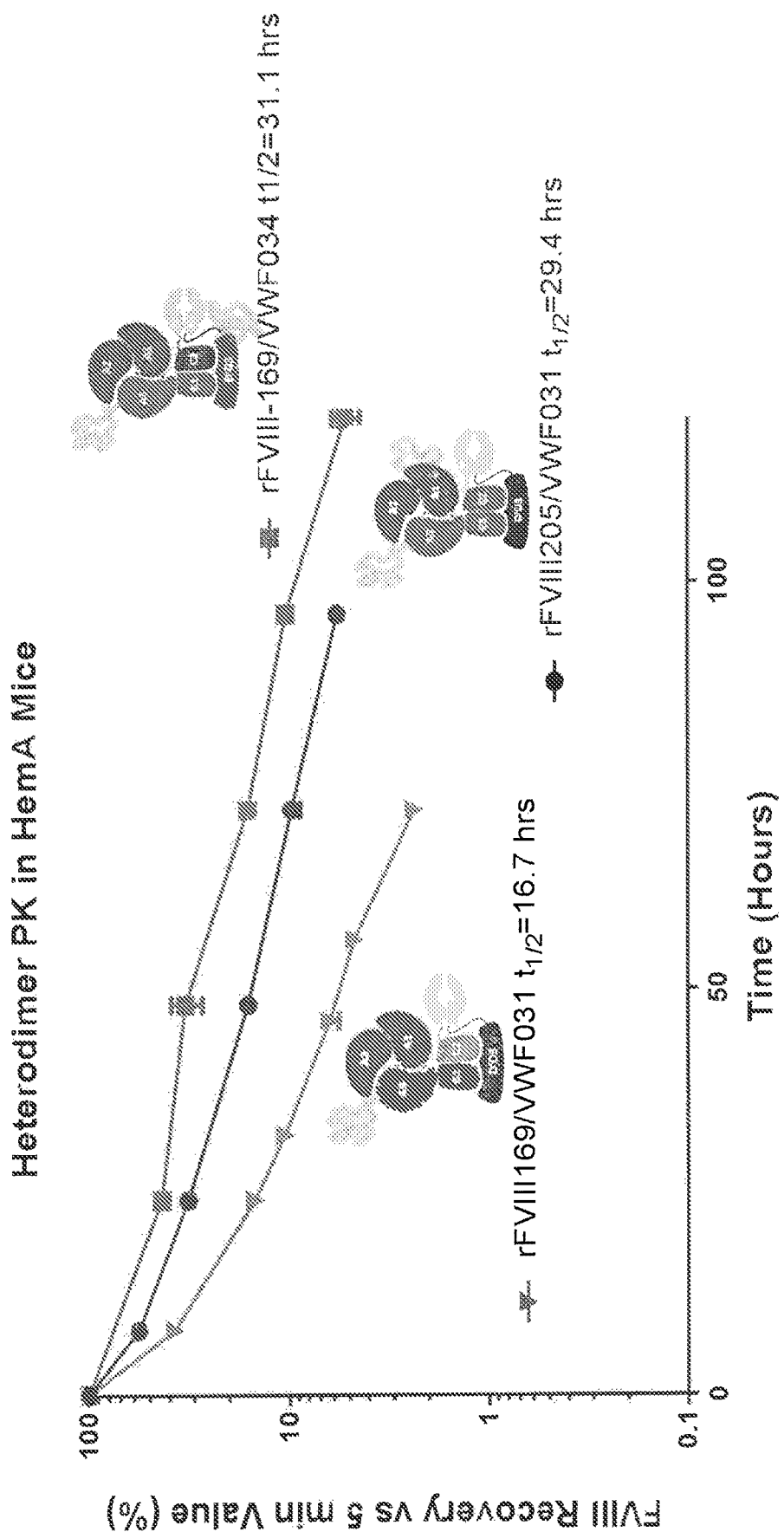

FIG. 3 shows additive effects of XTEN insertions on the half-life extension of the heterodimers. FVIII169 comprises a B domain deleted FVIII protein fused to an Fc region, wherein an XTEN sequence (e.g., AE288) is inserted at amino acid 745 corresponding to mature full length FVIII. FVIII205 comprises a B domain deleted FVIII protein fused to an Fc region, wherein an XTEN sequence (e.g., AE144) is inserted at amino acid 18 corresponding to mature full length FVIII and another XTEN sequence (e.g., AE288) is inserted at amino acid 745 corresponding to mature full length FVIII. VWF031 comprises a D' domain and a D3 domain of VWF fused to an Fc region by a thrombin cleavable linker (no XTEN). VWF034 comprises a D' domain and a D3 domain of VWF fused to AE288 and an Fc region. The half-life of FVIII169/VWF031 (inverted triangle) is 16.7 hours in HemA mice; the half-life of FVIII205/VWF031 (circle) is 29.4 hours in HemA mice; and the half-life of FVIII169/VWF034 (square) is 31.1 hours in HemA mice.

Figure 4:
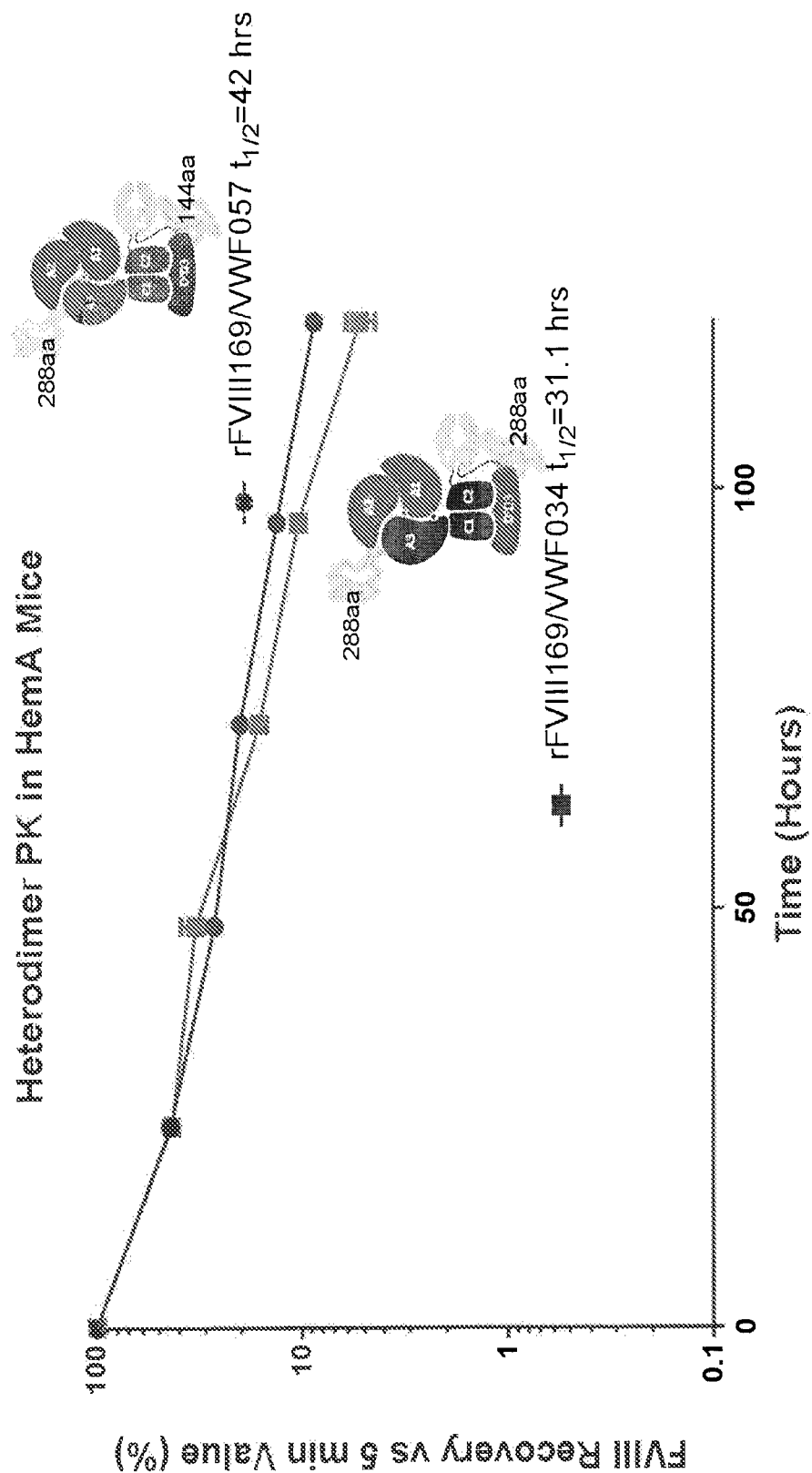

FIG. 4 shows that AE144 XTEN confers better half-life extension than AE288 XTEN when inserted between the D'D3 domains of VWF and Fc domains. For example, while the half-life of VWF169/VWF034 (square) is 31.1. hours in HemA mice, the half-life of FVIII169/VWF057 (circle) is 42 hours in HemA mice. VWF057 comprises D'D3 domains of VWF fused to AE144 and an Fc region.

Figure 5:
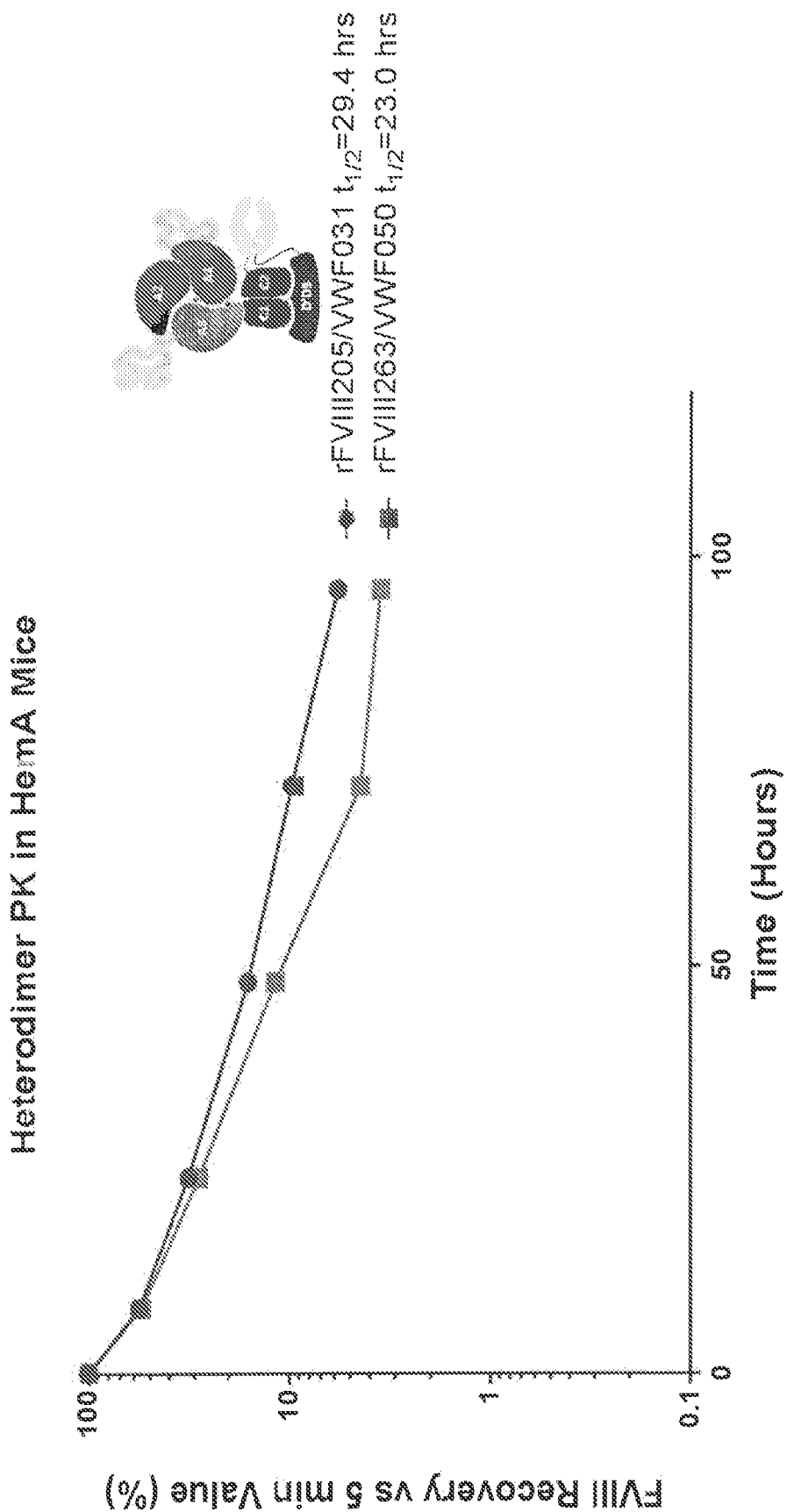

FIG. 5 shows that Fc domains are needed for half-life extension of the chimeric protein heterodimers. When the half-life of FVIII205/VWF031 (circle) was compared in HemA mice with that of FVIII263NWF050 (square), which contains mutations at the FcRn binding sites (IHH triple mutation Fc) and thus cannot be recycled through FcRn pathway, the half-life of FVIII263/VWF050 (23 hours) is shorter than that of VWF205/VWF031 (29.4 hours). This indicates that the Fc regions are necessary for half-life extension.

FIG. 6A shows similar acute efficacy of FVIII-XTEN-Fc/D'D3-XTEN-Fc heterodimers compared to B domain deleted FVIII (SQ BDD FVIII) in HemA mice tail clip model. Mice were dosed at 75 IU/kg, and the activity was measured by aPTT assay. SQ BDD FVIII is shown as circle while FVIII169/VWF034 is shown as square, FVIII169NWF057 is shown as diamond, and vehicle is shown as inverted triangle. The construct details of FVIII169, VWF034, and VWF057 are shown elsewhere herein. FIG. 6B shows a comparison of the acute efficacy of FVIII169/VWF034 with B domain deleted FVIII (SQ BDD FVIII) in HemA mice at 37.5 IU/kg dose, and the activity was measured by aPTT assay. The median blood loss (uL) of mice in each treatment groups are indicated by the horizontal lines, blood loss (uL) in C57/BL6 mice is shown as hollow triangle; the blood loss (uL) after dosing of 37.5 IU/kg of rBDD-FVIII is shown as hollow circle; the blood loss (uL) after dosing of 37.5 IU/kg FVIII169/VWF034 is shown as hollow square and the blood loss (uL) after dosing of vehicle is shown as inverted triangle.

FIGS. 7A-B show that rFVIII169/VWF057 heterodimer provides longer protection to HemA mice in Tail Vein Transection Bleeding Model. FIG. 7A shows the rebleeding data in mice that received rFVIII169/VWF057 at 72 hours before tail injury (square), SQ BDD-FVIII at 48 hours before tail injury (diamond), SQ BDD FVIII at 24 hours before tail injury (inverted triangle), and vehicle (circle). The activity was measured by aPTT assay. X-axis shows time in hours, and the Y axis shows percent of Non-Bleeders. FIG. 7B shows the corresponding survival data in the four categories of the mice shown in FIG. 7A. The mice received 12 IU/kg of FVIII169/VWF057 72 hours prior to tail injury showed similar protection on re-bleeding and survival compared to the mice received SQ BDD FVIII treatment 24 hour before the tail injury.

Figure 8:
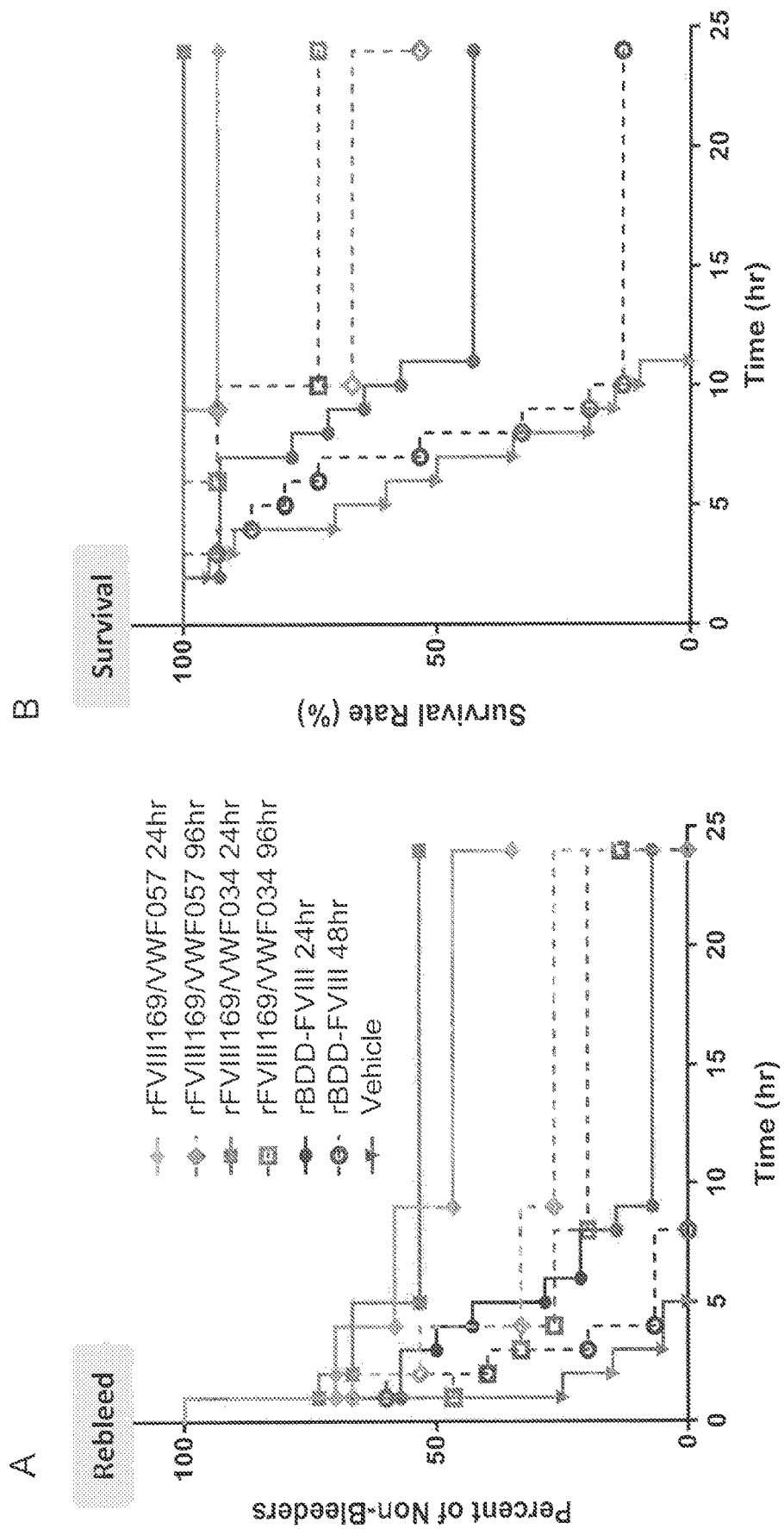

FIG. 8A shows the comparable rebleeding data in mice that received rFVIII-XTEN-Fc/D'D3-XTEN-Fc Heterodimers at 96 hours versus rBDD-FVIII at 24 hours before the injury. Filled squares show the rebleeding data in mice received FVIII169/VWF034 at 24 hours before the injury; hollow squares show the rebleeding data in mice received FVIII169/VWF034 at 96 hours before the injury; filled diamond show the rebleeding data in mice received FVIII169/VWF057 at 24 hours before the injury; hollow diamond show the rebleeding data in mice received FVIII169/VWF057 at 96 hours before the injury; filled circles show the rebleeding data in mice received rBDD- FVIII at 24 hours before the injury; hollow circles show the rebleeding data in mice received rBDD-FVIII at 48 hours before the injury; and filled triangle show the rebleeding data in mice received vehicle. X axis shows time in hours, and y axis shows percent of Non-Bleeders FIG. 8B shows the survival curve in mice that received rFVIII-XTEN-Fc/D'D3-XTEN-Fc heterodimers at 96 hours versus rBDD-FVIII at 24 hours before the injury. X axis shows time in hours, and y axis shows percent of survival. The symbols are the same as FIG. 8A.

Figure 9:
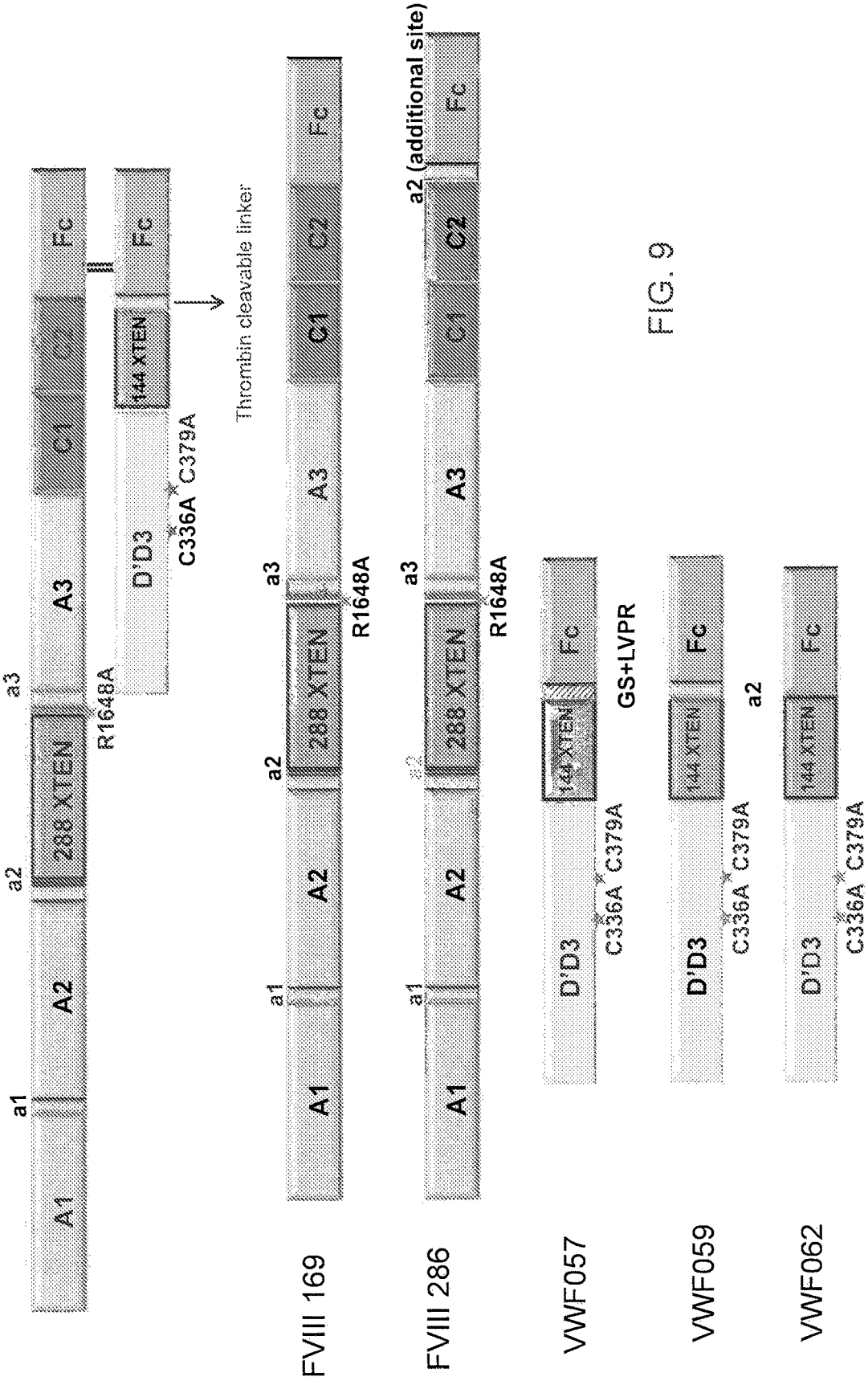

FIG. 9 shows a diagram of representative FVIII-VWF heterodimers and FVIII169, FVIII286, VWF057, VWF059, and VWF062 constructs. For example, FVIII169 construct comprises a B domain deleted FVIII protein with R1648A substitution fused to an Fc region, wherein an XTEN sequence (e.g., AE288) is inserted at amino acid 745 corresponding to mature full length FVIII (A1-a1-A2-a2-288XTEN-a3-A3-C1-C2-Fc). FVIII286 construct comprises a B domain deleted FVIII protein with R1648 substitution fused to an Fc region, wherein an XTEN sequence (e.g., AE288) is inserted at amino acid 745 corresponding to mature full length FVIII, with additional a2 region in between FVIII and Fc (A1-a1-A2-a2-288XTEN-a3-A3-C1-C2-a2-Fc). VWF057 is a VWF-Fc fusion construct that comprises D'D3 domain of the VWF protein (with two amino acid substitutions in D'D3 domain, i.e., C336A and C379A) linked to the Fc region via a VWF linker, which comprises LVPRG thrombin site ("LVPRG"; SEQ ID NO: 6) and GS linker ("GS"), wherein an XTEN sequence (i.e., AE144) is inserted between D'D3 domain and the VWF linker (D'D3-144XTEN-GS+LVPRG-Fc). VWF059 is a VWF-Fc fusion construct that comprises D'D3 domain of the VWF protein (with two amino acid substitutions in D'D3 domain, i.e., C336A and C379A) linked to the Fc region via an acidic region 2 (a2) of FVIII as a VWF linker, wherein an XTEN sequence (i.e., AE144) is inserted between D'D3 domain and the VWF linker. VWF062 is a VWF-Fc fusion construct that comprises D'D3 domain of the VWF protein (with two amino acid substitutions in D'D3 domain, i.e., C336A and C379A) linked to the Fc region, wherein an XTEN sequence (i.e., AE144) is inserted between D'D3 domain and the Fc region (D'D3-144XTEN-Fc).

Figure 10:
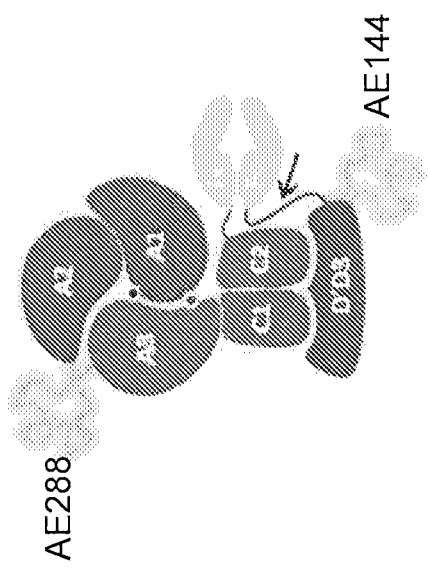

FIG. 10 shows a schematic diagram representing FVIII/VWF heterodimer constructs, for example, FVIII169NWF057, FVIII169/VWF059, FVIII169/VWF059A, and FVIII169/VWF073. The arrow shows the site where an optional linker is added to introduce a thrombin cleavage site. FVIII169/VWF057 has a linker comprising LVPRG (SEQ ID NO: 6). FVIII169/VWF059 has a linker comprising the FVIII a2 region (i.e., (i.e., ISDKNTGDYYEDSYEDISAYLLSKNNAIEPRSFSDKTH (SEQ ID NO: 106)).

FVIII169/VWF059A has a linker comprising a truncated FVIII a2 region (i.e., (i.e., DKNTGDYYEDSYEDISAYLLSKNNAIEPRSFSDKTH

(SEQ ID NO: 88)).

FVIII169/VWF073 has a linker within the VWF073 construct (SEQ ID NO: 175) comprising a fragment of the FVIII a2 region consisting of IEPRSFS (SEQ ID NO: 194).

FIGS. 11A-C show SDS-PAGE images following thrombin digestion of FVIII169/VWF057 and a FVIII-Fc control.

FIG. 11A shows staining of the SDS-PAGE gel with an anti-D3 antibody (AB 96340). Arrows highlight "LCFc:D'D3-XTEN-Fc," which is the un-cleaved, full-length FVIII169/VWF057; and "D'D3-144 XTEN," which is the resulting fragment following cleavage by thrombin. FIG. 11B shows staining of the SDS-PAGE gel with an anti-HC antibody (GMA012). Arrows highlight the FVIII heavy chain ("HC") and FVIII A2 domain. FIG. 11C shows the overlay of panels A and B. Samples were collected at the time points indicated at the top of each panel. Arrows point to the relevant proteins.

Figure 12:
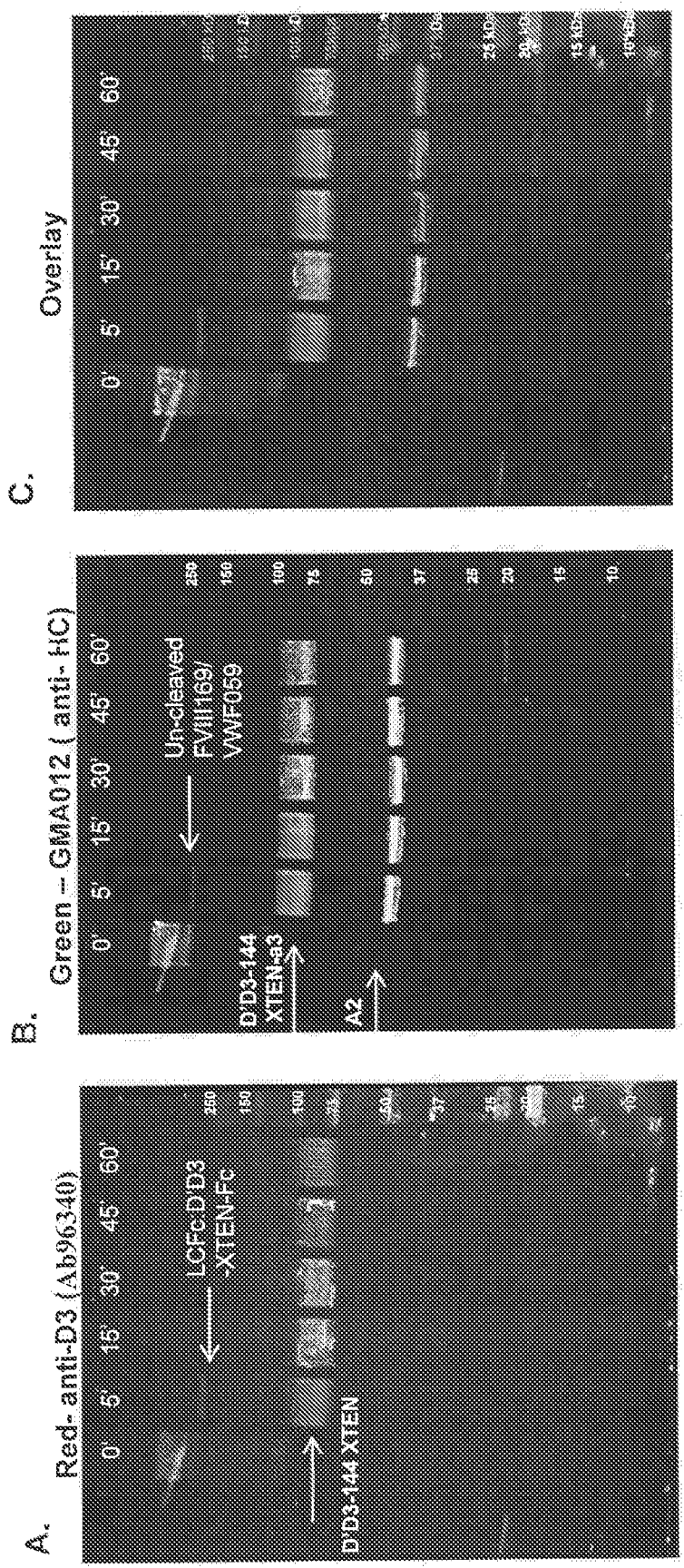
Figure 13:
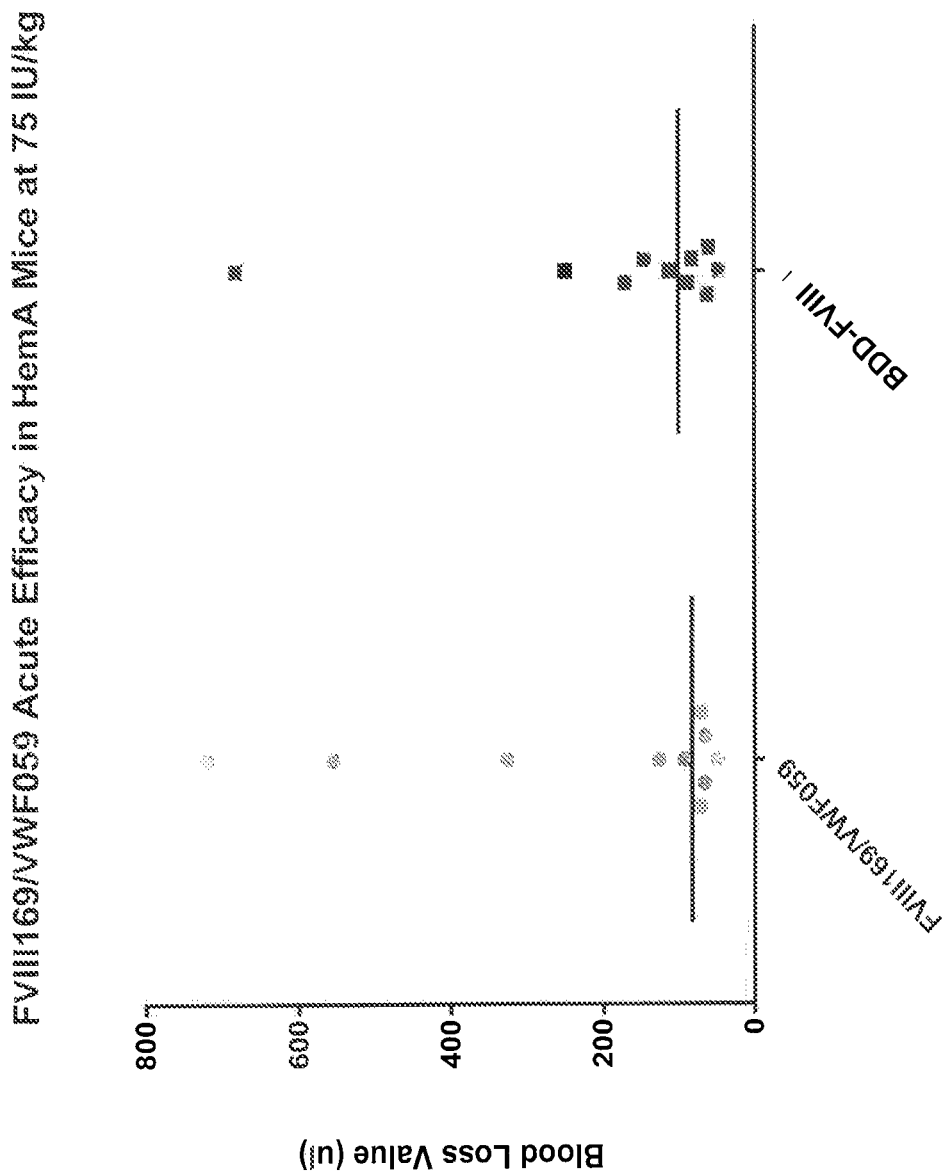

FIGS. 12A-C shows SDS-PAGE images following thrombin digestion of FVIII169/VWF059. FIG. 12A shows staining of the SDS-PAGE gel with an anti-D3 antibody (AB 96340). Arrows highlight "LCFc:D'D3-XTEN-Fc," which is the un-cleaved, full-length FVIII169/VWF059; and "D'D3-144 XTEN," which is the resulting fragment following cleavage by thrombin. FIG. 12B shows staining of the SDS-PAGE gel with an anti-HC antibody (GMA012). Arrows highlight the un-cleaved, full length FVIII169/VWF059; D'D3-144 XTEN-a3, which is the resulting fragment following cleavage by thrombin; and "A2," which is the A2 domain of FVIII. FIG. 12C shows the overlay of panels A and B. Samples were collected at the time points indicated at the top of each panel FIG. 13 shows acute efficacy data of HemA mice treated with FVIII169NWF059 (circle) as compared to HemA mice treated with a BDD-FVIII control (Square). Blood loss value was measured following tail clip. p=0.9883.

DETAILED DESCRIPTION OF THE INVENTION

The present invention is directed to a chimeric protein comprising two polypeptides, a first polypeptide comprising a FVIII protein fused to a first Ig constant region and a second polypeptide comprising a VWF protein fused to a second Ig constant region or a portion thereof by an XTEN sequence, wherein the XTEN sequence contains less than 288 amino acids.

I. Definitions

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Systeme International de Unites (SI) accepted form. Numeric ranges are inclusive of the numbers defining the range. Unless otherwise indicated, amino acid sequences are written left to right in amino to carboxy orientation. The headings provided herein are not limitations of the various aspects of the disclosure, which can be had by reference to the specification as a whole. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower).

The term "polynucleotide" or "nucleotide" is intended to encompass a singular nucleic acid as well as plural nucleic acids, and refers to an isolated nucleic acid molecule or construct, e.g., messenger RNA (mRNA) or plasmid DNA (pDNA). In certain embodiments, a polynucleotide comprises a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. By "isolated" nucleic acid or polynucleotide is intended a nucleic acid molecule, DNA or RNA, which has been removed from its native environment. For example, a recombinant polynucleotide encoding a Factor VIII polypeptide contained in a vector is considered isolated for the purposes of the present invention. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present invention. Isolated polynucleotides or nucleic acids according to the present invention further include such molecules produced synthetically. In addition, a polynucleotide or a nucleic acid can include regulatory elements such as promoters, enhancers, ribosome binding sites, or transcription termination signals.

As used herein, a "coding region" or "coding sequence" is a portion of polynucleotide which consists of codons translatable into amino acids. Although a "stop codon" (TAG, TGA, or TAA) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide. Two or more coding regions of the present invention can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding domain-A and a binding domain-B as described below. In addition, a vector, polynucleotide, or nucleic acid of the invention can encode heterologous coding regions, either fused or unfused to a nucleic acid encoding a binding domain of the invention. Heterologous coding regions include without limitation specialized elements or motifs, such as a secretory signal peptide or a heterologous functional domain.

Certain proteins secreted by mammalian cells are associated with a secretory signal peptide which is cleaved from the mature protein once export of the growing protein chain across the rough endoplasmic reticulum has been initiated. Those of ordinary skill in the art are aware that signal peptides are generally fused to the N-terminus of the polypeptide, and are cleaved from the complete or "full-length" polypeptide to produce a secreted or "mature" form of the polypeptide. In certain embodiments, a native signal peptide or a functional derivative of that sequence that retains the ability to direct the secretion of the polypeptide that is operably associated with it. Alternatively, a heterologous mammalian signal peptide, e.g., a human tissue plasminogen activator (TPA) or mouse β-glucuronidase signal peptide, or a functional derivative thereof, can be used.

The term "downstream," when refers to a nucleotide sequence, means that a nucleic acid or a nucleotide sequence is located 3' to a reference nucleotide sequence. In certain embodiments, downstream nucleotide sequences relate to sequences that follow the starting point of transcription. For example, the translation initiation codon of a gene is located downstream of the start site of transcription. The term "downstream," when refers to a polypeptide sequence, means that the amino acid or an amino acid insertion site is located at the C-terminus of the reference amino acids. For example, an insertion site immediately downstream of amino acid 745 corresponding to the mature wild type FVIII protein means that the insertion site is between amino acid 745 and amino acid 746 corresponding to the mature wild type FVIII protein.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

As used herein, the term "regulatory region" refers to nucleotide sequences located upstream (5' non-coding sequences), within, or downstream (3' non-coding sequences) of a coding region, and which influence the transcription, RNA processing, stability, or translation of the associated coding region. Regulatory regions may include promoters, translation leader sequences, introns, polyadenylation recognition sequences, RNA processing sites, effector binding sites and stem-loop structures. If a coding region is intended for expression in a eukaryotic cell, a polyadenylation signal and transcription termination sequence will usually be located 3' to the coding sequence.

A polynucleotide which encodes a gene product, e.g., a polypeptide, can include a promoter and/or other transcription or translation control elements operably associated with one or more coding regions. In an operable association a coding region for a gene product, e.g., a polypeptide, is associated with one or more regulatory regions in such a way as to place expression of the gene product under the influence or control of the regulatory region(s). For example, a coding region and a promoter are "operably associated" if induction of promoter function results in the transcription of mRNA encoding the gene product encoded by the coding region, and if the nature of the linkage between the promoter and the coding region does not interfere with the ability of the promoter to direct the expression of the gene product or interfere with the ability of the DNA template to be transcribed. Other transcription control elements, besides a promoter, for example enhancers, operators, repressors, and transcription termination signals, can also be operably associated with a coding region to direct gene product expression.

A variety of transcription control regions are known to those skilled in the art. These include, without limitation, transcription control regions which function in vertebrate cells, such as, but not limited to, promoter and enhancer segments from cytomegaloviruses (the immediate early promoter, in conjunction with intron-A), simian virus 40 (the early promoter), and retroviruses (such as Rous sarcoma virus). Other transcription control regions include those derived from vertebrate genes such as actin, heat shock protein, bovine growth hormone and rabbit β-globin, as well as other sequences capable of controlling gene expression in eukaryotic cells. Additional suitable transcription control regions include tissue-specific promoters and enhancers as well as lymphokine-inducible promoters (e.g., promoters inducible by interferons or interleukins).

Similarly, a variety of translation control elements are known to those of ordinary skill in the art. These include, but are not limited to ribosome binding sites, translation initiation and termination codons, and elements derived from picornaviruses (particularly an internal ribosome entry site, or IRES, also referred to as a CITE sequence).

The term "expression" as used herein refers to a process by which a polynucleotide produces a gene product, for example, an RNA or a polypeptide. It includes without limitation transcription of the polynucleotide into messenger RNA (mRNA), transfer RNA (tRNA), small hairpin RNA (shRNA), small interfering RNA (siRNA) or any other RNA product, and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

A "vector" refers to any vehicle for the cloning of and/or transfer of a nucleic acid into a host cell. A vector may be a replicon to which another nucleic acid segment may be attached so as to bring about the replication of the attached segment. A "replicon" refers to any genetic element (e.g., plasmid, phage, cosmid, chromosome, virus) that functions as an autonomous unit of replication in vivo, i.e., capable of replication under its own control. The term "vector" includes both viral and nonviral vehicles for introducing the nucleic acid into a cell in vitro, ex vivo or in vivo. A large number of vectors are known and used in the art including, for example, plasmids, modified eukaryotic viruses, or modified bacterial viruses. Insertion of a polynucleotide into a suitable vector can be accomplished by ligating the appropriate polynucleotide fragments into a chosen vector that has complementary cohesive termini.

Vectors may be engineered to encode selectable markers or reporters that provide for the selection or identification of cells that have incorporated the vector. Expression of selectable markers or reporters allows identification and/or selection of host cells that incorporate and express other coding regions contained on the vector. Examples of selectable marker genes known and used in the art include: genes providing resistance to ampicillin, streptomycin, gentamycin, kanamycin, hygromycin, bialaphos herbicide, sulfonamide, and the like; and genes that are used as phenotypic markers, i.e., anthocyanin regulatory genes, isopentanyl transferase gene, and the like. Examples of reporters known and used in the art include: luciferase (Luc), green fluorescent protein (GFP), chloramphenicol acetyltransferase (CAT), -galactosidase (LacZ), -glucuronidase (Gus), and the like. Selectable markers may also be considered to be reporters.

The term "plasmid" refers to an extra-chromosomal element often carrying a gene that is not part of the central metabolism of the cell, and usually in the form of circular double-stranded DNA molecules. Such elements may be autonomously replicating sequences, genome integrating sequences, phage or nucleotide sequences, linear, circular, or supercoiled, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

Eukaryotic viral vectors that can be used include, but are not limited to, adenovirus vectors, retrovirus vectors, adeno-associated virus vectors, and poxvirus, e.g., vaccinia virus vectors, baculovirus vectors, or herpesvirus vectors. Non-viral vectors include plasmids, liposomes, electrically charged lipids (cytofectins), DNA-protein complexes, and biopolymers.

A "cloning vector" refers to a "replicon," which is a unit length of a nucleic acid that replicates sequentially and which comprises an origin of replication, such as a plasmid, phage or cosmid, to which another nucleic acid segment may be attached so as to bring about the replication of the attached segment. Certain cloning vectors are capable of replication in one cell type, e.g., bacteria and expression in another, e.g., eukaryotic cells. Cloning vectors typically comprise one or more sequences that can be used for selection of cells comprising the vector and/or one or more multiple cloning sites for insertion of nucleic acid sequences of interest.

The term "expression vector" refers to a vehicle designed to enable the expression of an inserted nucleic acid sequence following insertion into a host cell. The inserted nucleic acid sequence is placed in operable association with regulatory regions as described above.

Vectors are introduced into host cells by methods well known in the art, e.g., transfection, electroporation, microinjection, transduction, cell fusion, DEAE dextran, calcium phosphate precipitation, lipofection (lysosome fusion), use of a gene gun, or a DNA vector transporter.

"Culture," "to culture" and "culturing," as used herein, means to incubate cells under in vitro conditions that allow for cell growth or division or to maintain cells in a living state. "Cultured cells," as used herein, means cells that are propagated in vitro.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide can be derived from a natural biological source or produced recombinant technology, but is not necessarily translated from a designated nucleic acid sequence. It can be generated in any manner, including by chemical synthesis.

An "isolated" polypeptide or a fragment, variant, or derivative thereof refers to a polypeptide that is not in its natural milieu. No particular level of purification is required. For example, an isolated polypeptide can simply be removed from its native or natural environment. Recombinantly produced polypeptides and proteins expressed in host cells are considered isolated for the purpose of the invention, as are native or recombinant polypeptides which have been separated, fractionated, or partially or substantially purified by any suitable technique.

Also included in the present invention are fragments or variants of polypeptides, and any combination thereof. The term "fragment" or "variant" when referring to polypeptide binding domains or binding molecules of the present invention include any polypeptides which retain at least some of the properties (e.g., FcRn binding affinity for an FcRn binding domain or Fc variant, coagulation activity for an FVIII variant, or FVIII binding activity for the VWF fragment) of the reference polypeptide. Fragments of polypeptides include proteolytic fragments, as well as deletion fragments, in addition to specific antibody fragments discussed elsewhere herein, but do not include the naturally occurring full-length polypeptide (or mature polypeptide). Variants of polypeptide binding domains or binding molecules of the present invention include fragments as described above, and also polypeptides with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions.

The term "VWF protein" or "VWF proteins" used herein means any VWF fragments that interact with FVIII and retain at least one or more properties that are normally provided to FVIII by full-length VWF, e.g., preventing premature activation to FVIIIa, preventing premature proteolysis, preventing association with phospholipid membranes that could lead to premature clearance, preventing binding to FVIII clearance receptors that can bind naked FVIII but not VWF-bound FVIII, and/or stabilizing the FVIII heavy chain and light chain interactions.

A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In another embodiment, a string of amino acids can be conservatively replaced with a structurally similar string that differs in order and/or composition of side chain family members.

As known in the art, "sequence identity" between two polypeptides is determined by comparing the amino acid sequence of one polypeptide to the sequence of a second polypeptide. When discussed herein, whether any particular polypeptide is at least about 50%, 60%, 70%, 75%, 80%, 85%, 90%, 95%, 99%, or 100% identical to another polypeptide can be determined using methods and computer programs/software known in the art such as, but not limited to, the BESTFIT program (Wisconsin Sequence Analysis Package, Version 8 for Unix, Genetics Computer Group, University Research Park, 575 Science Drive, Madison, Wis. 53711). BESTFIT uses the local homology algorithm of Smith and Waterman, Advances in Applied Mathematics 2:482-489 (1981), to find the best segment of homology between two sequences. When using BESTFIT or any other sequence alignment program to determine whether a particular sequence is, for example, 95% identical to a reference sequence according to the present invention, the parameters are set, of course, such that the percentage of identity is calculated over the full-length of the reference polypeptide sequence and that gaps in homology of up to 5% of the total number of amino acids in the reference sequence are allowed.

As used herein, an "amino acid corresponding to" or an "equivalent amino acid" in a VWF sequence or a FVIII protein sequence is identified by alignment to maximize the identity or similarity between a first VWF or FVIII sequence and a second VWF or FVIII sequence. The number used to identify an equivalent amino acid in a second VWF or FVIII sequence is based on the number used to identify the corresponding amino acid in the first VWF or FVIII sequence.

As used herein, the term "insertion site" refers to a position in a FVIII polypeptide, or fragment, variant, or derivative thereof, which is immediately upstream of the position at which a heterologous moiety can be inserted. An "insertion site" is specified as a number, the number being the number of the amino acid in mature native FVIII (SEQ ID NO: 65) to which the insertion site corresponds, which is immediately N-terminal to the position of the insertion. For example, the phrase "a3 comprises an XTEN at an insertion site which corresponds to amino acid 1656 of SEQ ID NO: 65" indicates that the heterologous moiety is located between two amino acids corresponding to amino acid 1656 and amino acid 1657 of SEQ ID NO: 65.

The phrase "immediately downstream of an amino acid" as used herein refers to position right next to the terminal carboxyl group of the amino acid. Similarly, the phrase "immediately upstream of an amino acid" refers to the position right next to the terminal amine group of the amino acid. Therefore, the phrase "between two amino acids of an insertion site" as used herein refers to a position in which an XTEN or any other polypeptide is inserted between two adjacent amino acids. Thus, the phrases "inserted immediately downstream of an amino acid" and "inserted between two amino acids of an insertion site" are used synonymously with "inserted at an insertion site."

The terms "inserted," "is inserted," "inserted into" or grammatically related terms, as used herein refers to the position of an XTEN in a chimeric polypeptide relative to the analogous position in native mature human FVIII. As used herein the terms refer to the characteristics of the recombinant FVIII polypeptide relative to native mature human FVIII, and do not indicate, imply or infer any methods or process by which the chimeric polypeptide was made. For example, in reference to a chimeric polypeptide provided herein, the phrase "an XTEN is inserted into immediately downstream of residue 745 of the FVIII polypeptide" means that the chimeric polypeptide comprises an XTEN immediately downstream of an amino acid which corresponds to amino acid 745 in native mature human FVIII, e.g., bounded by amino acids corresponding to amino acids 745 and 746 of native mature human FVIII.

A "fusion" or "chimeric" protein comprises a first amino acid sequence linked to a second amino acid sequence with which it is not naturally linked in nature. The amino acid sequences which normally exist in separate proteins can be brought together in the fusion polypeptide, or the amino acid sequences which normally exist in the same protein can be placed in a new arrangement in the fusion polypeptide, e.g., fusion of a Factor VIII domain of the invention with an Ig Fc domain. A fusion protein is created, for example, by chemical synthesis, or by creating and translating a polynucleotide in which the peptide regions are encoded in the desired relationship. A chimeric protein can further comprises a second amino acid sequence associated with the first amino acid sequence by a covalent, non-peptide bond or a non-covalent bond.

As used herein, the term "half-life" refers to a biological half-life of a particular polypeptide in vivo. Half-life may be represented by the time required for half the quantity administered to a subject to be cleared from the circulation and/or other tissues in the animal. When a clearance curve of a given polypeptide is constructed as a function of time, the curve is usually biphasic with a rapid α-phase and longer β-phase. The α-phase typically represents an equilibration of the administered Fc polypeptide between the intra- and extra-vascular space and is, in part, determined by the size of the polypeptide. The β-phase typically represents the catabolism of the polypeptide in the intravascular space. In some embodiments, FVIII and chimeric proteins comprising FVIII are monophasic, and thus do not have an alpha phase, but just the single beta phase. Therefore, in certain embodiments, the term half-life as used herein refers to the half-life of the polypeptide in the β-phase. The typical 13 phase half-life of a human antibody in humans is 21 days.

The term "linked" as used herein refers to a first amino acid sequence or nucleotide sequence covalently or non-covalently joined to a second amino acid sequence or nucleotide sequence, respectively. The first amino acid or nucleotide sequence can be directly joined or juxtaposed to the second amino acid or nucleotide sequence or alternatively an intervening sequence can covalently join the first sequence to the second sequence. The term "linked" means not only a fusion of a first amino acid sequence to a second amino acid sequence at the C-terminus or the N-terminus, but also includes insertion of the whole first amino acid sequence (or the second amino acid sequence) into any two amino acids in the second amino acid sequence (or the first amino acid sequence, respectively). In one embodiment, the first amino acid sequence can be linked to a second amino acid sequence by a peptide bond or a linker. The first nucleotide sequence can be linked to a second nucleotide sequence by a phosphodiester bond or a linker. The linker can be a peptide or a polypeptide (for polypeptide chains) or a nucleotide or a nucleotide chain (for nucleotide chains) or any chemical moiety (for both polypeptide and polynucleotide chains). The term "linked" is also indicated by a hyphen (-).

As used herein the term "associated with" refers to a covalent or non-covalent bond formed between a first amino acid chain and a second amino acid chain. In one embodiment, the term "associated with" means a covalent, non-peptide bond or a non-covalent bond. This association can be indicated by a colon, i.e., (:). In another embodiment, it means a covalent bond except a peptide bond. For example, the amino acid cysteine comprises a thiol group that can form a disulfide bond or bridge with a thiol group on a second cysteine residue. In most naturally occurring IgG molecules, the CH1 and CL regions are associated by a disulfide bond and the two heavy chains are associated by two disulfide bonds at positions corresponding to 239 and 242 using the Kabat numbering system (position 226 or 229, EU numbering system). Examples of covalent bonds include, but are not limited to, a peptide bond, a metal bond, a hydrogen bond, a disulfide bond, a sigma bond, a pi bond, a delta bond, a glycosidic bond, an agnostic bond, a bent bond, a dipolar bond, a Pi backbond, a double bond, a triple bond, a quadruple bond, a quintuple bond, a sextuple bond, conjugation, hyperconjugation, aromaticity, hapticity, or antibonding. Non-limiting examples of non-covalent bond include an ionic bond (e.g., cation-pi bond or salt bond), a metal bond, an hydrogen bond (e.g., dihydrogen bond, dihydrogen complex, low-barrier hydrogen bond, or symmetric hydrogen bond), van der Walls force, London dispersion force, a mechanical bond, a halogen bond, aurophilicity, intercalation, stacking, entropic force, or chemical polarity.

The term "monomer-dimer hybrid" used herein refers to a chimeric protein comprising a first polypeptide chain and a second polypeptide chain, which are associated with each other by a disulfide bond, wherein the first chain comprises a clotting factor, e.g., Factor VIII, and a first Fc region and the second chain comprises, consists essentially of, or consists of a second Fc region without the clotting factor. The monomer-dimer hybrid construct thus is a hybrid comprising a monomer aspect having only one clotting factor and a dimer aspect having two Fc regions.

As used herein, the term "cleavage site" or "enzymatic cleavage site" refers to a site recognized by an enzyme. Certain enzymatic cleavage sites comprise an intracellular processing site. In one embodiment, a polypeptide has an enzymatic cleavage site cleaved by an enzyme that is activated during the clotting cascade, such that cleavage of such sites occurs at the site of clot formation. Exemplary such sites include, e.g., those recognized by thrombin, Factor XIa or Factor Xa. Exemplary FXIa cleavage sites include, e.g., TQSFNDFTR (SEQ ID NO: 1) and SVSQTSKLTR (SEQ ID NO: 3). Exemplary thrombin cleavage sites include, e.g., DFLAEGGGVR (SEQ ID NO: 4), TTKIKPR (SEQ ID NO: 5), LVPRG (SEQ ID NO: 6), ALRPR (SEQ ID NO: 7), ISDKNTGDYYEDSYEDISAY-LLSKNNAIEPRSFS (SEQ ID NO: 106), DKNTGDYYED-SYEDISAYLLSKNNAIEPRSFS (SEQ ID NO: 88), and IEPRSFS (SEQ ID NO: 194). Other enzymatic cleavage sites are known in the art and described in elsewhere herein.

As used herein, the term "processing site" or "intracellular processing site" refers to a type of enzymatic cleavage site in a polypeptide which is a target for enzymes that function after translation of the polypeptide. In one embodiment, such enzymes function during transport from the Golgi lumen to the trans-Golgi compartment. Intracellular processing enzymes cleave polypeptides prior to secretion of the protein from the cell. Examples of such processing sites include, e.g., those targeted by the PACE/furin (where PACE is an acronym for Paired basic Amino acid Cleaving Enzyme) family of endopeptidases. These enzymes are localized to the Golgi membrane and cleave proteins on the carboxyterminal side of the sequence motif Arg-[any residue]-(Lys or Arg)-Arg. As used herein the "furin" family of enzymes includes, e.g., PCSK1 (also known as PC1/Pc3), PCSK2 (also known as PC2), PCSK3 (also known as furin or PACE), PCSK4 (also known as PC4), PCSK5 (also known as PC5 or PC6), PCSK6 (also known as PACE4), or PCSK7 (also known as PC7/LPC, PC8, or SPC7). Other processing sites are known in the art.

In constructs that include more than one processing or cleavage site, it will be understood that such sites may be the same or different.

The term "Furin" refers to the enzymes corresponding to EC No. 3.4.21.75. Furin is subtilisin-like proprotein convertase, which is also known as PACE (Paired basic Amino acid Cleaving Enzyme). Furin deletes sections of inactive precursor proteins to convert them into biologically active proteins. During its intracellular transport, pro-peptide of VWF can be cleaved from mature VWF molecule by a Furin enzyme. In some embodiments, Furin cleaves the D1D2 from the D'D3 of VWF. In other embodiments, a nucleotide sequence encoding Furin can be expressed together with the nucleotide sequence encoding a VWF fragment so that D1D2 domains can be cleaved off intracellularly by Furin.

In constructs that include more than one processing or cleavage site, it will be understood that such sites may be the same or different.

A "processable linker" as used herein refers to a linker comprising at least one intracellular processing site, which are described elsewhere herein.

Hemostatic disorder, as used herein, means a genetically inherited or acquired condition characterized by a tendency to hemorrhage, either spontaneously or as a result of trauma, due to an impaired ability or inability to form a fibrin clot. Examples of such disorders include the hemophilias. The three main forms are hemophilia A (factor VIII deficiency), hemophilia B (factor IX deficiency or "Christmas disease") and hemophilia C (factor XI deficiency, mild bleeding tendency). Other hemostatic disorders include, e.g., Von Willebrand disease, Factor XI deficiency (PTA deficiency), Factor XII deficiency, deficiencies or structural abnormalities in fibrinogen, prothrombin, Factor V, Factor VII, Factor X or factor XIII, Bernard-Soulier syndrome, which is a defect or deficiency in GPIb. GPIb, the receptor for VWF, can be defective and lead to lack of primary clot formation (primary hemostasis) and increased bleeding tendency), and thrombasthenia of Glanzman and Naegeli (Glanzmann thrombasthenia). In liver failure (acute and chronic forms), there is insufficient production of coagulation factors by the liver; this may increase bleeding risk.

The chimeric molecules of the invention can be used prophylactically. As used herein the term "prophylactic treatment" refers to the administration of a molecule prior to a bleeding episode. In one embodiment, the subject in need of a general hemostatic agent is undergoing, or is about to undergo, surgery. The chimeric protein of the invention can be administered prior to or after surgery as a prophylactic. The chimeric protein of the invention can be administered during or after surgery to control an acute bleeding episode. The surgery can include, but is not limited to, liver transplantation, liver resection, dental procedures, or stem cell transplantation.

The chimeric protein of the invention is also used for on-demand treatment. The term "on-demand treatment" refers to the administration of a chimeric molecule in response to symptoms of a bleeding episode or before an activity that may cause bleeding. In one aspect, the on-demand treatment can be given to a subject when bleeding starts, such as after an injury, or when bleeding is expected, such as before surgery. In another aspect, the on-demand treatment can be given prior to activities that increase the risk of bleeding, such as contact sports.

As used herein the term "acute bleeding" refers to a bleeding episode regardless of the underlying cause. For example, a subject may have trauma, uremia, a hereditary bleeding disorder (e.g., factor VII deficiency) a platelet disorder, or resistance owing to the development of antibodies to clotting factors.

Treat, treatment, treating, as used herein refers to, e.g., the reduction in severity of a disease or condition; the reduction in the duration of a disease course; the amelioration of one or more symptoms associated with a disease or condition; the provision of beneficial effects to a subject with a disease or condition, without necessarily curing the disease or condition, or the prophylaxis of one or more symptoms associated with a disease or condition. In one embodiment, the term "treating" or "treatment" means maintaining a FVIII trough level at least about 1 IU/dL, 2 IU/dL, 3 IU/dL, 4 IU/dL, 5 IU/dL, 6 IU/dL, 7 IU/dL, 8 IU/dL, 9 IU/dL, 10 IU/dL, 11 IU/dL, 12 IU/dL, 13 IU/dL, 14 IU/dL, 15 IU/dL, 16 IU/dL, 17 IU/dL, 18 IU/dL, 19 IU/dL, or 20 IU/dL in a subject by administering a chimeric protein or a VWF fragment of the invention. In another embodiment, treating or treatment means maintaining a FVIII trough level between about 1 and about 20 IU/dL, about 2 and about 20 IU/dL, about 3 and about 20 IU/dL, about 4 and about 20 IU/dL, about 5 and about 20 IU/dL, about 6 and about 20 IU/dL, about 7 and about 20 IU/dL, about 8 and about 20 IU/dL, about 9 and about 20 IU/dL, or about 10 and about 20 IU/dL. Treatment or treating of a disease or condition can also include maintaining FVIII activity in a subject at a level comparable to at least about 1%, 2%, 3%, 4%, 5%, 6%, 7%, 8%, 9%, 10%, 11%, 12%, 13%, 14%, 15%, 16%, 17%, 18%, 19%, or 20% of the FVIII activity in a non-hemophiliac subject. The minimum trough level required for treatment can be measured by one or more known methods and can be adjusted (increased or decreased) for each person.

II. Chimeric Proteins

The present invention is directed to extending a half-life of a chimeric protein using a VWF protein fused to an XTEN sequence by preventing or inhibiting a FVIII half-life limiting factor, i.e., endogenous VWF, from associating with the FVIII protein. Endogenous VWF associates with about 95% to about 98% of FVIII in non-covalent complexes. While endogenous VWF is a FVIII half-life limiting factor, endogenous VWF bound to a FVIII protein is also known to protect FVIII in various ways. For example, full length VWF (as a multimer having about 250 kDa) can protect FVIII from protease cleavage and FVIII activation, stabilize the FVIII heavy chain and/or light chain, and prevent clearance of FVIII by scavenger receptors. But, at the same time, endogenous VWF limits the FVIII half-life by preventing pinocytosis and by clearing FVIII-VWF complex from the system through the VWF clearance pathway. It is believed, while not bound by a theory, that endogenous VWF is a half-life limiting factor that prevents the half-life of a chimeric protein fused to a half-life extender from being longer than about two-fold that of wild-type FVIII. Therefore, the present invention is directed to preventing or inhibiting interaction between endogenous VWF and a FVIII protein using a VWF protein comprising a D' domain and a D3 domain (e.g., a VWF fragment) and at the same time to increasing a half-life of resulting FVIII protein(s) by using an XTEN sequence in combination with an Ig constant region or a portion thereof. In particular, the present invention shows that a shorter XTEN sequence (i.e., XTEN that contains less than 288 amino acids in length, i.e., XTEN that is shorter than 288 amino acids) is better in extending a half-life of the chimeric protein.

In one embodiment, the invention is directed to a chimeric protein comprising (i) a first polypeptide which comprises a FVIII protein fused to a first Ig constant region or a portion thereof and (ii) a second polypeptide which comprises a VWF protein comprising a D' domain and a D3 domain of VWF fused to a second Ig constant region or a portion thereof by an XTEN sequence in-between, wherein the XTEN sequence contains less than 288 amino acid residues and wherein the first polypeptide is linked to or associated with the second polypeptide. In another embodiment, the XTEN sequence in the second polypeptide consists of an amino acid sequence having a length of between 12 amino acids and 287 amino acids. In other embodiments, the chimeric protein exhibits a longer half-life compared to a corresponding fusion protein comprising the first polypeptide and the second polypeptide, wherein the second polypeptide comprises an XTEN sequence containing at least 288 amino acids, e.g., AE288, e.g., SEQ ID NO: 8. In still other embodiments, the XTEN sequence in the second polypeptide contains at least about 36, at least about 42, at least about 72, or at least about 144 amino acids, but less than 288 amino acids, e.g., AE42, AE72, AE144 (AE144, AE144_2A, AE144_3B, AE144_4A, AE144_5A, AE144_6B), AG42, AG72, or AG144 (AG144, AG144_A, AG144_B, AG144_C, AG144_F), e.g., SEQ ID NO: 9, SEQ ID NO: 10, SEQ ID NO: 11, SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63.

The chimeric protein of the invention can further comprise a second XTEN sequence which links the FVIII protein with the first Ig constant region or a portion thereof.

In certain embodiments, the invention is directed to a chimeric protein comprising (i) a first polypeptide which comprises a FVIII protein fused to a first Ig constant region or a portion thereof and (ii) a second polypeptide which comprises a VWF protein comprising a D' domain and a D3 domain of VWF fused to a second Ig constant region or a portion thereof by a first XTEN sequence in-between, wherein the XTEN sequence contains less than 288 amino acid residues and wherein the first polypeptide are linked to or associated with the second polypeptide, and wherein the first polypeptide further comprises a second XTEN sequence which is inserted at one or more insertion sites within the FVIII protein or which is fused to the FVIII protein and/or the first Ig constant region or a portion thereof. Therefore, in one embodiment, a second XTEN sequence is inserted at one or more insertion sites within the FVIII protein. In another embodiment, a second XTEN sequence is fused to the FVIII protein and/or the first Ig constant region or a portion thereof. In other embodiments, a second XTEN sequence is inserted at one or more insertion sites within the FVIII protein and a third XTEN sequence is fused to the FVIII protein and/or the first Ig constant region or a portion thereof.

The second and/or third XTEN sequences can be any length of XTEN amino acids. For example, the second and/or third XTEN sequences are disclosed elsewhere herein, e.g., AE42, AE72, AE864, AE576, AE288, AE144, AG864, AG576, AG288, and AG144, e.g., SEQ ID NO: 8; SEQ ID NO: 9, SEQ ID NO: 10, SEQ ID NO: 11, SEQ ID NO: 17; SEQ ID NO: 54; SEQ ID NO: 19; SEQ ID NO: 16; SEQ ID NO: 18; SEQ ID NO: 15; SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63. In a particular embodiment, the second and/or third XTEN sequence is AE288 or AG288, e.g., SEQ ID NO: 8 or 19.

In certain embodiments, the invention is directed to a chimeric protein comprising (i) a first polypeptide which comprises a FVIII protein fused to a first Ig constant region or a portion thereof by an optional linker, wherein an optional XTEN sequence (X2) is inserted at one or more insertion sites within the FVIII protein or is fused to the FVIII protein or to the first Ig constant region or a portion thereof, and (ii) a second polypeptide which comprises a VWF protein comprising a D' domain and a D3 domain of VWF fused to a second Ig constant region or a portion thereof by an XTEN sequence (X1) between the VWF protein and the second Ig constant region or a portion thereof, wherein the XTEN sequence (X1) contains less than 288 amino acid residues and is fused to the VWF protein by a linker and wherein the first polypeptide and the second polypeptide are associated. In some embodiments, the invention is directed to a chimeric protein comprising (i) a first polypeptide which comprises a FVIII protein fused to a first Ig constant region or a portion thereof by an optional linker, wherein an optional XTEN sequence (X2) is inserted at one or more insertion sites within the FVIII protein or is fused to the FVIII protein or to the first Ig constant region or a portion thereof, and (ii) a second polypeptide which comprises a VWF protein comprising a D' domain and a D3 domain of VWF fused to a second Ig constant region or a portion thereof by an XTEN sequence (X1) between the VWF protein and the second Ig constant region or a portion thereof, wherein the XTEN sequence (X1) contains less than 288 amino acid residues and is fused to the second Ig constant region or a portion thereof by a linker and wherein the first polypeptide and the second polypeptide are associated. In other embodiments, the linker fusing the XTEN sequence (X1) with the VWF protein or the second Ig constant region or a portion thereof is a cleavable linker. Non-limiting examples of the cleavable linkers are shown elsewhere herein. In a particular embodiment, the linker is a thrombin cleavable linker.

In some embodiments, the chimeric protein is two polypeptide chains, the first chain comprising the first polypeptide described above and the second chain comprising the second polypeptide described above. For example, the two polypeptide chains comprise (i) a first chain comprising a single chain FVIII protein, a first Ig constant region or a portion thereof, and an optional XTEN sequence which is inserted at one or more insertion sites within the FVIII protein or is fused to the FVIII protein or to the first Ig constant region or a portion thereof, and (ii) a second chain comprising a VWF protein fused to a second Ig constant region or a portion thereof by an XTEN sequence (X1) in-between, wherein the XTEN sequence (X1) contains less than 288 amino acids.

In certain embodiments, the chimeric protein is two polypeptide chains, a first chain comprising a heavy chain of a FVIII protein and a second chain comprising, from N-terminus to C-terminus, a light chain of a FVIII protein, an optional XTEN sequence which is inserted at one or more insertion sites within the FVIII protein or is fused to the FVIII protein or to the first Ig constant region or a portion thereof, and a first Ig constant region or a portion thereof, an optional linker (e.g., a processable linker), a VWF protein, an XTEN sequence (X1), a second optional linker (e.g., a cleavable linker), and a second Ig constant region or a portion thereof.

In other embodiments, the chimeric protein is three polypeptide chains, (i) a first chain comprising a heavy chain of a FVIII protein, (ii) a second chain comprising a light chain of a FVIII protein, a first Ig constant region or a portion thereof, and an optional XTEN sequence which is inserted at one or more insertion sites within the heavy chain or the light chain of the FVIII protein or is fused to the FVIII protein or to the first Ig constant region or a portion thereof, and (iii) a third chain comprising a VWF protein fused to a second Ig constant region or a portion thereof by an XTEN sequence (X1) in-between, wherein the first chain and the second chain are associated by a non-covalent bond, e.g., a metal bond, and the second chain and the third chain are associated by a covalent bond, e.g., a disulfide bond.

In still other embodiments, the chimeric protein is a single chain comprising, from N terminus to C terminus, a single chain FVIII protein, an optional XTEN sequence which is inserted at one or more insertion sites within the FVIII protein or is fused to the FVIII protein or to the first Ig constant region or a portion thereof, and a first Ig constant region or a portion thereof, an optional linker (e.g., a processable linker), a VWF protein, an XTEN sequence (X1), a second optional linker (e.g., a cleavable linker), and a second Ig constant region or a portion thereof.

In certain embodiments, a chimeric protein comprises one of the following formulae (a)-(hh):
(a) FVIII-F1:F2-L2-X-L1-V;
(b) FVIII-F1:V-L1-X-L2-F2;
(c) F1-FVIII:F2-L2-X-L1-V;
(d) F1-FVIII:V-L1-X-L2-F2;
(e) FVIII-X2-F1:F2-L2-X1-L1-V;
(f) FVIII-X2-F1:V-L1-X1-L2-F2;
(g) FVIII(X2)-F1:F2-L2-X1-L1-V;
(h) FVIII(X2)-F1:V-L1-X1-L2-F2;
(i) F1-X2-F1:F2-L2-X1-L1-V;
(j) F1-X2-F1:V-L1-X1-L2-F2;
(k) V-L1-X-L2-F2-L3-FVIII-L4-F1;
(l) V-L1-X-L2-F2-L3-F1-L4-FVIII;
(m) F1-L4-FVIII-L3-F2-L2-X-L1-V;
(n) FVIII-L4-F1-L3-F2-L2-X-L1-V;
(o) FVIII-L4-F1-L3-V-L1-X-L2-F2;
(p) FVIII-L4-F1-L3-F2-L2-X-L1-V;
(q) F2-L2-X-L1-V-L3-F1-L4-FVIII;
(r) F2-L2-X-L1-V-L3-FVIII-L4-F1;
(s) V-L1-X1-L2-F2-L3-FVIII(X2)-L4-F1;
(t) V-L1-X1-L2-F2-L3-F1-L4-FVIII(X2);
(u) F1-L4-FVIII(X2)-L3-F2-L2-X1-L1-V;
(v) F-L4-FVIII(X2)-L3-V-L1-X1-L2-F2;
(w) FVIII(X2)-L4-F1-L3-V-L1-X1-L2-F2;
(x) FVIII(X2)-L4-F1-L3-F2-L2-X1-L1-V;
(y) F2-L2-X1-L1-V-L3-F1-L4-FVIII(X2);
(z) F2-L2-X1-L1-V-L3-FVIII(X2)-L4-F1;
(aa) V-L1-X2-L2-F2-L3-FVIII-L4-X2-L5-F1;
(bb) V-L1-X2-L2-F2-L3-F1-L5-X2-L4-FVIII;
(cc) F1-L5-X2-L4-FVIII-L3-F2-L2-X2-L1-V;
(dd) F1-L5-X2-L4-FVIII-L3-V-L1-X2-L2-F2;
(ee) FVIII-L5-X2-L4-F2-L3-V-L1-X1-L2-F1;
(ff) FVIII-L5-X2-L4-F2-L3-F1-L2-X1-L1-V;
(gg) F1-L2-X1-L1-V-L3-F2-L4-X2-L5-FVIII; or
(hh) F1-L2-X1-L1-V-L3-FVIII-L5-X2-L4-F2;

wherein V is a VWF protein, which comprises a D' domain and a D3 domain,

X or X1 is a first XTEN sequence that contains less than 288 amino acids,

X2 is a second XTEN sequence,

FVIII comprises a FVIII protein,

FVIII(X2) comprises a FVIII protein having a second XTEN sequence inserted in one or more insertion sites within the FVIII protein, F1 is a first Ig constant region or a portion thereof, F2 is a second Ig constant region or a portion thereof, L1, L2, L3, L4, or L5 is an optional linker, (-) is a peptide bond; and (:) is a covalent bond or a non-covalent bond.

In one embodiment, the X or X1 consists of an amino acid sequence having a length of between 12 amino acids and 287 amino acids. In another embodiment, the chimeric protein exhibits a longer half-life compared to a corresponding fusion protein comprising a formula wherein the X or X1 is AE288, e.g., SEQ ID NO: 8.

In other embodiments, the X or X1 in the formula contains at least about 36, at least about 42, at least about 72, or at least about 144 amino acids, but less than 288 amino acids, e.g., AE42, AE72, AE144 (AE144, AE144_2A, AE144_3B, AE144_4A, AE144_5A, AE144_6B), AG42, AG72, or AG144 (AG144, AG144_A, AG144_B, AG144_C, AG144_F), e.g., SEQ ID NO: 9, SEQ ID NO: 10, SEQ ID NO: 11, SEQ ID NO: 55; SEQ ID NO: 56; SEQ ID NO: 57; SEQ ID NO: 58; SEQ ID NO: 59; SEQ ID NO: 14; SEQ ID NO: 60; SEQ ID NO: 61; SEQ ID NO: 62; or SEQ ID NO: 63.

In yet other embodiments, the X2 comprises an amino acid sequence having a length of at least about 36 amino acids, at least 42 amino acids, at least 144 amino acids, at least 288 amino acids, at least 576 amino acids, or at least 864 amino acids, e.g., AE42, AE72, AE864, AE576, AE288, AE144, AG864, AG576, AG288, or AG144, e.g., SEQ ID NO: 9; SEQ ID NO: 10; SEQ ID NO: 15; SEQ ID NO: 16; SEQ ID NO: 8; SEQ ID NO: 11; SEQ ID NO: 17; SEQ ID NO: 18, SEQ ID NO: 19, or SEQ ID NO: 14. In a particular embodiment, the X2 is AE288 or AG288, e.g., SEQ ID NO: 8 or 19.

In certain embodiments, the chimeric protein comprising the X or X1 and/or X2 has an extended half-life compared to a chimeric protein without the X or X1 and/or X2. In other embodiments, the L1 and/or L2 is a cleavable linker. In still other embodiments, the L4 and/or L5 is a cleavable linker.

II.A. Von Willebrand Factor (VWF) Proteins

VWF (also known as F8VWF) is a large multimeric glycoprotein present in blood plasma and produced constitutively in endothelium (in the Weibel-Palade bodies), megakaryocytes (α-granules of platelets), and subendothelian connective tissue. The basic VWF monomer is a 2813 amino acid protein. Every monomer contains a number of specific domains with a specific function, the D'/D3 domain (which binds to Factor VIII), the A1 domain (which binds to platelet GPIb-receptor, heparin, and/or possibly collagen), the A3 domain (which binds to collagen), the C1 domain (in which the RGD domain binds to platelet integrin αIIbβ3 when this is activated), and the "cysteine knot" domain at the C-terminal end of the protein (which VWF shares with platelet-derived growth factor (PDGF), transforming growth factor-β (TGFβ) and β-human chorionic gonadotropin (βHCG)).

In one embodiment, the VWF protein is a VWF fragment. The term "a VWF fragment" as used herein includes, but is not limited to, functional VWF fragments comprising a D' domain and a D3 domain, which are capable of inhibiting binding of endogenous VWF to FVIII. In one embodiment, the VWF fragment binds to the FVIII protein. In another embodiment, the VWF fragment blocks the VWF binding site on the FVIII protein, thereby inhibiting interaction of the FVIII protein with endogenous VWF. The VWF fragments include derivatives, variants, mutants, or analogues that retain these activities of VWF.

The 2813 monomer amino acid sequence for human VWF is reported as Accession Number _NP_000543.2 in Genbank. The nucleotide sequence encoding the human VWF is reported as Accession Number _NM_000552.3_ in Genbank. A nucleotide sequence of human VWF is designated as SEQ ID NO: 20. SEQ ID NO: 21 is the amino acid sequence of full-length VWF. Each domain of VWF is listed in Table 1.

TABLE 1

VWF Sequences

| VWF domains | | Amino acid Sequence | | |
|---|---|---|---|---|
| VWF Signal Peptide (Amino acids 1 to 22 of SEQ ID NO: 21) | 1 | MIPARFAGVL LALALILPGT LC | | 22 |
| VWF D1D2 region (Amino acids 23 to 763 of SEQ ID NO: 21) | | AEGTRGRS STARCSLFGS DFVNTFDGSM | | |
| | 51 | YSFAGYCSYL LAGGCQKRSF SIIGDFQNGK RVSLSVYLGE FFDIHLFVNG | | |
| | 101 | TVTQGDQRVS MPYASKGLYL ETEAGYYKLS GEAYGFVARI DGSGNFQVLL | | |
| | 151 | SDRYFNKTCG LCGNFNIFAE DDFMTQEGTL TSDPYDFANS WALSSGEQWC | | |
| | 201 | ERASPPSSSC NISSGEMQKG LWEQCQLLKS TSVFARCHPL VDPEPFVALC | | |
| | 251 | EKTLCECAGG LECACPALLE YARTCAQEGM VLYGWTDHSA CSPVCPAGME | | |
| | 301 | YRQCVSPCAR TCQSLHINEM CQERCVDGCS CPEGQLLDEG LCVESTECPC | | |
| | 351 | VHSGKRYPPG TSLSRDCNTC ICRNSQWICS NEECPGECLV TGQSHFKSFD | | |
| | 401 | NRYFTFSGIC QYLLARDCQD HSFSIVIETV QCADDRDAVC TRSVTVRLPG | | |
| | 451 | LHNSLVKLKH GAGVAMDGQD IQLPLLKGDL RIQHTVTASV RLSYGEDLQM | | |
| | 501 | DWDGRGRLLV KLSPVYAGKT CGLCGNYNGN QGDDFLTPSG LAEPRVEDFG | | |
| | 551 | NAWKLHGDCQ DLQKQHSDPC ALNPRMTRFS EEACAVLTSP TFEACHRAVS | | |
| | 601 | PLPYLRNCRY DVCSCSDGRE CLCGALASYA AACAGRGVRV AWREPGRCEL | | |
| | 651 | NCPKGQVYLQ CGTPCNLTCR SLSYPDEECN EACLEGCFCP PGLYMDERGD | | |
| | 701 | CVPKAQCPCY YDGEIFQPED IFSDHHTMCY CEDGFMHCTM SGVPGSLLPD | | |
| | 751 | AVLSSPLSHR SKR | | 763 |
| VWF D' Domain | 764 | SLSCRPP MVKLVCPADN LRAEGLECTK TCQNYDLECM | | |
| | 801 | SMGCVSGCLC PPGMVRHENR CVALERCPCF HQGKEYAPGE TVKIGCNTCV | | |
| | 851 | CRDRKWNCTD HVCDAT | | 866 |
| VWF D3 Domain | 867 | YVLVQDYCGS CSTI GMAHYLTFDG LKYLFPGECQ | | |
| | 901 | NPGTFRILVG NKGCSHPSVK CKKRVTILVE GGEIELFDGE VNVKRPKDE | | |
| | 951 | THFEVVESGR UIILLLGKAL SVVWDRHLSI SVVLKQTYQE KVCGLCGNFD | | |
| | 1001 | GIQNNDLTSS NLQVEEDPVD FGNSWKVSSQ CADTRKVPLD SSPATCHNNI | | |
| | 1051 | MKQTMVDSSC RILTSDVFQD CNKLVDPEPY LDVCIYDTCS CESIGDCACF | | |

TABLE 1-continued

VWF Sequences

VWF domains

|  |  |
|---|---|
|  | 1101 CDTIAAYAHV CAQHGKVVTW RTATLCPQSC EERNLRENGY ECEWRYNSCA |
|  | 1151 PACQVTCQHP EPLACPVQCV EGCHAHCPPG KILDELLQTC VDPEDCPVCE |
|  | 1201 VAGRRFASGK KVTLNPSDPE HCQICHCDVV NLTCEACQEP |
|  | 1240 |

| VWF A1 Domain | |
|---|---|
|  | 1241 GGLVVPPTDA |
|  | 1251 PVSPTTLYVE DISEPPLHDF YCSRLLDLVF LLDGSSRLSE AEFEVLKAFV |
|  | 1301 VDMMERLRIS QKWVRVAVVE YHDGSHAYIG LKDRKRPSEL RRIASQVKYA |
|  | 1351 GSQVASTSEV LKYTLFQIFS KIDRPEASRI ALLLMASQEP QRMSRNFVRY |
|  | 1401 VQGLKKKKVI VIPVGIGPHA NLKQIRLIEK QAPENKAFVL SSVDELEQQR |
|  | 1451 DEIVSYLCDL APEAPPPTLP PDMAQVTVG            1479 |
|  | 1480            P GLLGVSTLGP KRNSMVLDVA |
|  | 1501 FVLEGSDKIG EADFNRSKEF MEEVIQRMDV GQDSIHVTVL QYSYMVTVEY |
|  | 1551 PFSEAQSKGD ILQRVREIRY QGGNRTNTGL ALRYLSDHSF LVSQGDREQA  1600 |
|  | 1601 PNLVYMVTGN PASDEIKRLP GDIQVVPIGV GPNANVQELE RIGWPNAPIL |
|  | 1651 IQDFETLPRE APDLVLQRCC SGEGLQIPTL SPAPDCSQPL DVILLLDGSS |
|  | 1701 SFPASYFDEM KSFAKAFISK ANIGPRLTQV SVLQYGSITT IDVPWNVVPE |
|  | 1751 KAHLLSLVDV MQREGGPSQI GDALGFAVRY LTSEMHGARP GASKAVVILV |
|  | 1801 TDVSVDSVDA AADAARSNRV TVFPIGIGDR YDAAQLRILA GPAGDSNVVK |
|  | 1851 LQRIEDLPTM VTLGNSFLHK LCSGFVRICM DEDGNEKRPG DVWTLPDQCH |
|  | 1901 TVTCQPDGQT LLKSHRVNCD RGLRPSCPNS QSPVKVEETC GCRWTCPCVC |
|  | 1951 TGSSTRHIVT FDGQNFKLTG SCSYVLFQNK EQDLEVILHN GACSPGARQG |
|  | 2001 CMKSIEVKHS ALSVEXHSDM EVTVNGRLVS VPYVGGNMEV NVYGAIMHEV |
|  | 2051 RFNHLGHIFT FTPQNNEFQL QLSPKTFASK TYGLCGICDE NGANDFMLRD |
|  | 2101 GTVTTDWKTL VQEWTVQRPG QTCQPILEEQ CLVPDSSHCQ VLLLPLFAEC |
|  | 2151 HKVLAPATFY AICQQDSCHQ EQVCEVIASY AHLCRTNGVC VDWRTPDFCA |
|  | 2201 MSCPPSLVYN HCEHGCPRHC DGNVSSCGDH PSEGCFCPPD KVMLEGSCVP |
|  | 2251 EEACTQCIGE DGVQHQFLEA WVPDHQPCQI CTCLSGRKVN CTTQPCPTAK |
|  | 2301 APTCGLCEVA RLRQNADQCC PEYECVCDPV SCDLPPVPHC ERGLQPTLTN |
|  | 2351 PGECRPNFTC ACRKEECKRV SPPSCPPHRL PTLRKTQCCD EYECACNCVN |
|  | 2401 STVSCPLGYL ASTATNDCGC TTTTCLPDKV CVHRSTIYPV GQFWEEGCDV |
|  | 2451 CTCTDMEDAV MGLRVAQCSQ KPCEDSCRSG FTYVLHEGEC CGRCLPSACE |
|  | 2501 VVTGSPRGDS QSSWKSVGSQ WASPENPCLI NECVRVKEEV FIQQRNVSCP |
|  | 2551 QLEVPVCPSG FQLSCKTSAC CPSCRCERME ACMLNGTVIG PGKTVMIDVC |
|  | 2601 TTCRCMVQVG VISGFKLECR KTTCNPCPLG YKEENNTGEC CGRCLPTACT |
|  | 2651 IQLRGGQIMT LKRDETLQDG CDTHFCKVNE RGEYFWEKRV TGCPPFDEHK |

TABLE 1-continued

VWF Sequences

VWF domains

|  |  |
|---|---|
| 2701 | CLAEGGKIMK IPGTCCDTCE EPECNDITAR LQYVKVGSCK SEVEVDIHYC |
| 2751 | QGKCASKAMY SIDINDVQDQ CSCCSPTRTE PMQVALHCTN GSVVYHEVLN |
| 2801 | AMECKCSPRK CSK |

Nucleotide Sequence (SEQ ID NO: 20)

Full-length VWF

|  |  |
|---|---|
| 1 | ATGATTCCTG CCAGATTTGC CGGGGTGCTG CTTGCTCTGG CCCTCATTTT |
| 51 | GCCAGGGACC CTTTGTGCAG AAGGAACTCG CGGCAGGTCA TCCACGGCCC |
| 101 | GATGCAGCCT TTTCGGAAGT GACTTCGTCA ACACCTTTGA TGGGAGCATG |
| 151 | TACAGCTTTG CGGGATACTG CAGTTACCTC CTGGCAGGGG GCTGCCAGAA |
| 201 | ACGTCCTTC TCGATTATTG GGGACTTCCA GAATGGCAAG AGAGTGAGCC |
| 251 | TCTCCGTGTA TCTTGGGGAA TTTTTTGACA TCCATTTGTT TGTCAATGGT |
| 301 | ACCGTGACAC AGGGGGACCA AAGAGTCTCC ATGCCCTATG CCTCCAAAGG |
| 351 | GCTGTATCTA GAAACTGAGG CTGGGTACTA CAAGCTGTCC GGTGAGGCCT |
| 401 | ATGGCTTTGT GGCCAGGATC GATGGCAGCG GCAACTTTCA AGTCCTGCTG |
| 451 | TCAGACAGAT ACTTCAACAA GACCTGCGGG CTGTGTGGCA ACTTTAACAT |
| 501 | CTTTGCTGAA GATGACTTTA TGACCCAAGA AGGGACCTTG ACCTCGGACC |
| 551 | CTTATGACTT TGCCAACTCA TGGGCTCTGA GCAGTGGAGA ACAGTGGTGT |
| 601 | GAACGGGCAT CTCCTCCCAG CAGCTCATGC AACATCTCCT CTGGGGAAAT |
| 651 | GCAGAAGGGC CTGTGGGAGC AGTGCCAGCT TCTGAAGAGC ACCTCGGTGT |
| 701 | TTGCCCGCTG CCACCCTCTG GTGGACCCCC AGCCTTTTGT GGCCCTGTGT |
| 751 | GAGAAGACTT TGTGTGAGTG TGCTGGGGGG CTGGAGTGCG CCTGCCCTGC |
| 801 | CCTCCTGGAG TACGCCCGGA CCTGTGCCCA GGAGGGAATG GTGCTGTACG |
| 851 | GCTGGACCGA CCACAGCGCG TGCAGCCCAG TGTGCCCTGC TGGTATGGAG |
| 901 | TATAGGCAGT GTGTGTCCCC TTGCGCCAGG ACCTGCCAGA GCCTGCACAT |
| 951 | CAATGAAATG TGTCAGGAGC GATGCGTGGA TGGCTGCAGC TGCCCTGAGG |
| 1001 | GACAGCTCCT GGATGAAGGC CTCTGCGTGG AGAGCACCGA GTGTCCCTGC |
| 1051 | GTGCATTCCG GAAAGCGCTA CCCTCCCGGC ACCTCCCTCT CTCGAGACTG |
| 1101 | CAACACCTGC ATTTGCCGAA ACAGCCAGTG GATCTGCAGC AATGAAGAAT |
| 1151 | GTCCAGGGGA GTGCCTTGTC ACTGGTCAAT CCCACTTCAA GAGCTTTGAC |
| 1201 | AACAGATACT TCACCTTCAG TGGGATCTGC CAGTACCTGC TGGCCCGGGA |
| 1251 | TTGCCAGGAC CACTCCTTCT CCATTGTCAT TGAGACTGTC CAGTGTGCTG |
| 1301 | ATGACCGCGA CGCTGTGTGC ACCCGCTCCG TCACCGTCCG GCTGCCTGGC |
| 1351 | CTGCACAACA GCCTTGTGAA ACTGAAGCAT GGGGCAGGAG TTGCCATGGA |
| 1401 | TGGCCAGGAC ATCCAGCTCC CCCTCCTGAA AGGTGACCTC CGCATCCAGC |
| 1451 | ATACAGTGAC GGCCTCCGTG CGCCTCAGCT ACGGGGAGGA CCTGCAGATG |
| 1501 | GACTGGGATG GCCGCGGGAG GCTGCTGGTG AAGCTGTCCC CCGTCTATGC |
| 1551 | CGGGAAGACC TGCGGCCTGT GTGGAATTA CAATGGCAAC CAGGGCGACG |
| 1601 | ACTTCCTTAC CCCCTCTGGG CTGGCRGAGC CCCGGGTGGA GGACTTCGGG |
| 1651 | AACGCCTGGA AGCTGCACGG GGACTGCCAG GACCTGCAGA AGCAGCACAG |

TABLE 1-continued

VWF Sequences

VWF domains

1701 CGATCCCTGC GCCCTCAACC CGCGCATGAC CAGGTTCTCC
     GAGGAGGCGT
1751 GCGCGGTCCT GACGTCCCCC ACATTCGAGG CCTGCCATCG
     TGCCGTCAGC
1801 CCGCTGCCCT ACCTGCGGAA CTGCCGCTAC GACGTGTGCT
     CCTGCTCGGA
1851 CGGCCGCGAG TGCCTGTGCG GCGCCCTGGC CAGCTATGCC
     GCGGCCTGCG
1901 CGGGGAGAGG CGTGCGCGTC GCGTGGCGCG AGCCAGGCCG
     CTGTGAGCTG
1951 AACTGCCCGA AAGGCCAGGT GTACCTGCAG TGCGGGACCC
     CCTGCAACCT
2001 GACCTGCCGC TCTCTCTCTT ACCCGGATGA GGAATGCAAT
     GAGGCCTGCC
2051 TGGAGGGCTG CTTCTGCCCC CCAGGGCTCT ACATGGATGA
     GAGGGGGGAC
2101 TGCGTGCCCA AGGCCCAGTG CCCCTGTTAC TATGACGGTG
     AGATCTTCCA
2151 GCCAGAAGAC ATCTTCTCAG ACCATCACAC CATGTGCTAC
     TGTGAGGATG
2201 GCTTCATGCA CTGTACCATG AGTGGAGTCC CCGGAAGCTT
     GCTGCCTGAC
2251 GCTGTCCTCA GCAGTCCCCT GTCTCATCGC AGCAAAAGGA
     GCCTATCCTG
2301 TCGGCCCCCC ATGGTCAAGC TGGTGTGTCC CGCTGACAAC
     CTGCGGGCTG
2351 AAGGGCTCGA GTGTACCAAA ACGTGCCAGA ACTATGACCT
     GGAGTGCATG
2401 AGCATGGGCT GTGTCTCTGG CTGCCTCTGC CCCCCGGGCA
     TGGTCCGGCA
2451 TGAGAACAGA TGTGTGGCCC TGGAAAGGTG TCCCTGCTTC
     CATCAGGGCA
2501 AGGAGTATGC CCCTGGAGAA ACAGTGAAGA TTGGCTGCAA
     CACTTGTGTC
2551 TGTCGGGACC GGAAGTGGAA CTGCACAGAC CATGTGTGTG
     ATGCCACGTG
2601 CTCCACGATC GGCATGGCCC ACTACCTCAC CTTCGACGGG
     CTCAAATACC
2651 TGTTCCCCGG GGAGTGCCAG TACGTTCTGG TGCAGGATTA
     CTGCGGCAGT
2701 AACCCTGGGA CCTTTCGGAT CCTAGTGGGG AATAAGGGAT
     GCAGCCACCC
2751 CTCAGTGAAA TGCAAGAAAC GGGTCACCAT CCTGGTGGAG
     GGAGGAGAGA
2801 TTGAGCTGTT TGACGGGGAG GTGAATGTGA AGAGGCCCAT
     GAAGGATGAG
2851 ACTCACTTTG AGGTGGTGGA GTCTGGCCGG TACATCATTC
     TGCTGCTGGG
2901 CAAAGCCCTC TCCGTGGTCT GGGACCGCCA CCTGAGCATC
     TCCGTGGTCC
2951 TGAAGCAGAC ATACCAGGAG AAAGTGTGTG GCCTGTGTGG
     GAATTTTGAT
3001 GGCATCCAGA ACAATGACCT CACCAGCAGC AACCTCCAAG
     TGGAGGAAGA
3051 CCCTGTGGAC TTTGGGAACT CCTGGAAAGT GAGCTCGCAG
     TGTGCTGACA
3101 CCAGAAAAGT GCCTCTGGAC TCATCCCCTG CCACCTGCCA
     TAACAACATC
3151 ATGAAGCAGA CGATGGTGGA TTCCTCCTGT AGAATCCTTA
     CCAGTGACGT
3201 CTTCCAGGAC TGCAACAAGC TGGTGGACCC CGAGCCATAT
     CTGGATGTCT
3251 GCATTTACGA CACCTGCTCC TGTGAGTCCA TTGGGGACTG
     CGCCTGCTTC
3301 TGCGACACCA TTGCTGCCTA TGCCCACGTG TGTGCCCAGC
     ATGGCAAGGT
3351 GGTGACCTGG AGGACGGCCA CATTGTGCCC CCAGAGCTGC
     GAGGAGAGGA
3401 ATCTCCGGGA GAACGGGTAT GAGTGTGAGT GGCGCTATAA
     CAGCTGTGCA
3451 CCTGCCTGTC AAGTCACGTG TCAGCACCCT GAGCCACTGG
     CCTGCCCTGT
3501 GCAGTGTGTG GAGGGCTGCC ATGCCCACTG CCCTCAGGGG
     AAAATCCTGG
3551 ATGAGCTTTT GCAGACCTGC GTTGACCCTG AAGACTGTCC
     AGTGTGTGAG

TABLE 1-continued

VWF Sequences

VWF domains

3601 GTGGCTGGCC GGCGTTTTGC CTCAGGAAAG AAAGTCACCT
     TGAATCCCAG
3651 TGACCCTGAG CACTGCCAGA TTTGCCACTG TGATGTTGTC
     AACCTCACCT
3701 GTGAAGCCTG CCAGGAGCCG GGAGGCCTGG TGGTGCCTCC
     CACAGATGCC
3751 CCGGTGAGCC CCACCACTCT GTATGTGGGA GACATCTCGG
     AACCGCCGTT
3801 GCACGATTTC TACTGCAGCA GGCTACTGGA CCTGGTCTTC
     CTGCTGGATG
3851 GCTCCTCCAG GCTGTCCGAG GCTGAGTTTG AAGTGCTGAA
     GGCCTTTGTG
3901 GTGGACATGA TGGAGCGGCT GCGCATCTCC CAGAAGTGGG
     TCCGCGTGGC
3951 CGTGGTGGAG TACCACGACG GCTCCCACGC CTACATCGGG
     CTCAAGGACC
4001 GGAAGCGACC GTCAGAGCTG CGGCGCATTG CCAGCCAGGT
     GAAGTATGCG
4051 GGCAGCCAGG TGGCCTCCAC CAGCGAGGTC TTGAAATACA
     CACTGTTCCA
4101 AATCTTCAGC AAGATCGACC GCCCTGAAGC CTCCCGCATC
     GCCCTGCTCC
4151 TGATGGCCAG CCAGGAGCCC CAACGGATGT CCCGGAACTT
     TGTCCGCTAC
4201 GTCCAGGGCC TGAAGAAGAA GAAGGTCATT GTGATCCCGG
     TGGGCATTGG
4251 GCCCCATGCC AACCTCAAGC AGATCCGCCT CATCGAGAAG
     CAGGCCCCTG
4301 AGAACAAGGC CTTCGTGCTG AGCAGTGTGG ATGAGCTGGA
     GCAGCAAAGG
4351 GACGAGATCG TTAGCTACCT CTGTGACCTT GCCCCTGAAG
     CCCCTCCTCC
4401 TACTCTGCCC CCCGACATGG CACAAGTCAC TGTGGGCCCG
     GGGCTCTTGG
4451 GGGTTTCGAC CCTGGGGCCC AAGAGGAACT CCATGGTTCT
     GGATGTGGCG
4501 TTCGTCCTGG AAGGATCGGA CAAAATTGGT GAAGCCGACT
     TCAACAGGAG
4551 CAAGGAGTTC ATGGAGGAGG TGATTCAGCG GATGGATGTG
     GGCCAGGACA
4601 GCATCCACGT CACGGTGCTG CAGTACTCCT ACATGGTGAC
     CGTGGAGTAC
4651 CCCTTCAGCG AGGCACAGTC CAAAGGGGAC ATCCTGCAGC
     GGGTGCGAGA
4701 GATCCGCTAC CAGGGCGGCA ACAGGACCAA CACTGGGCTG
     GCCCTGCGGT
4751 ACCTCTCTGA CCACAGCTTC TTGGTCAGCC AGGGTGACCG
     GGAGCAGGCG
4801 CCCAACCTGG TCTACATGGT CACCGGAAAT CCTGCCTCTG
     ATGAGATCAA
4851 GAGGCTGCCT GGAGACATCC AGGTGGTGCC CATTGGAGTG
     GGCCCTAATG
4901 CCAACGTGCA GGAGCTGGAG AGGATTGGCT GGCCCAATGC
     CCCTATCCTC
4951 ATCCAGGACT TTGAGACGCT CCCCCGAGAG GCTCCTGACC
     TGGTGCTGCA
5001 GAGGTGCTGC TCCGGAGAGG GGCTGCAGAT CCCCACCCTC
     TCCCCTGCAC
5051 CTGACTGCAG CCAGCCCCTG GACGTGATCC TTCTCCTGGA
     TGGCTCCTCC
5101 AGTTTCCCAG CTTCTTATTT TGATGAAATG AAGAGTTTCG
     CCAAGGCTTT
5151 CATTTCAAAA GCCAATATAG GCCTCGTCT CACTCAGGTG
     TCAGTGCTGC
5201 AGTATGGAAG CATCACCACC ATTGACGTGC CATGGAACGT
     GGTCCCGGAG
5251 AAAGCCCATT TGCTGAGCCT TGTGGACGTC ATGCAGCGGG
     AGGGAGGCCC
5301 CAGCCAAATC GGGGATGCCT TGGGCTTTGC TGTGCGATAC
     TTGACTTCAG
5351 AAATGCATGG TGCCAGGCCG GGAGCCTCAA AGGCGGTGGT
     CATCCTGGTC
5401 ACGGACGTCT CTGTGGATTC AGTGGATGCA GCAGCTGATG
     CCGCCAGGTC
5451 CAACAGAGTG ACAGTGTTCC CTATTGGAAT TGGAGATCGC
     TACGATGCAG

TABLE 1-continued

VWF Sequences

VWF domains

```
5501 CCCAGCTACG GATCTTGGCA GGCCCAGCAG GCGACTCCAA
     CGTGGTGAAG
5551 CTCCAGCGAA TCGAAGACCT CCCTACCATG GTCACCTTGG
     GCAATTCCTT
5601 CCTCCACAAA CTGTGCTCTG GATTTGTTAG GATTTGCATG
     GATGAGGATG
5651 GGAATGAGAA GAGGCCCGGG GACGTCTGGA CCTTGCCAGA
     CCAGTGCCAC
5701 ACCGTGACTT GCCAGCCAGA TGGCCAGACC TTGCTGAAGA
     GTCATCGGGT
5751 CAACTGTGAC CGGGGGCTGA GGCCTTCGTG CCCTAACAGC
     CAGTCCCCTG
5801 TTAAAGTGGA AGAGACCTGT GGCTGCCGCT GGACCTGCCC
     CTGYGTGTGC
5851 ACAGGCAGCT CCACTCGGCA CATCGTGACC TTTGATGGGC
     AGAATTTCAA
5901 GCTGACTGGC AGCTGTTCTT ATGTCCTATT TCAAAACAAG
     GAGCAGGACC
5951 TGGAGGTGAT TCTCCATAAT GGTGCCTGCA GCCCTGGAGC
     AAGGCAGGGC
6001 TGCATGAAAT CCATCGAGGT GAAGCACAGT GCCCTCTCCG
     TCGAGSTGCA
6051 CAGTGACATG GAGGTGACGG TGAATGGGAC ACTGGTCTCT
     GTTCCTTACG
6101 TGGGTGGGAA CATGGAAGTC AACGTTTATG GTGCCATCAT
     GCATGAGGTC
6151 AGATTCAATC ACCTTGGTCA CATCTTCACA TTCACTCCAC
     AAAACAATGA
6201 GTTCCAACTG CAGCTCAGCC CCAAGACTTT TGCTTCAAAG
     ACGTATGGTC
6251 TGTGTGGGAT CTGTGATGAG AACGGAGCCA ATGACTTCAT
     GCTGAGGGAT
6301 GGCACAGTCA CCACAGACTG GAAAACACTT GTTCAGGAAT
     GGACTGTGCA
6351 GCGGCCAGGG CAGACGTGCC AGCCCATCCT GGAGGAGCAG
     TGTCTTGTCC
6401 CCGACAGCTC CCACTGCCAG GTCCTCCTCT TACCACTGTT
     TGCTGAATGC
6451 CACAAGGTCC TGGCTCCAGC CACATTCTAT GCCATCTGCC
     AGCAGGACAG
6501 TTGCCACCAG GAGCAAGTGT GTGAGGTGAT CGCCTCTTAT
     GCCCACCTCT
6551 GTCGGACCAA CGGGGTCTGC GTTGACTGGA GGACACCTGA
     TTTCTGTGCT
6601 ATGTCATGCC CACCATCTCT GGTCTACAAC CACTGTGAGC
     ATGGCTGTCC
6651 CCGGCACTGT GATGGCAACG TGAGCTCCTG TGGGGACCAT
     CCCTCCGAAG
6701 GCTGTTTCTG CCCTCCAGAT AAAGTCATGT TGGAAGGCAG
     CTGTGTCCCT
6751 GAAGAGGCCT GCACTCAGTG CATTGGTGAG GATGGAGTCC
     AGCACCAGTT
6801 CCTGGAAGCC TGGGTCCCGG ACCACCAGCC CTGTCAGATC
     TGCACATGCC
6851 TCAGCGGGCG GAAGGTCAAC TGCACAACGC AGCCCTGCCC
     CACGGCCAAA
6901 GCTCCCACGT GTGGCCTGTG TGAAGTAGCC CGCCTCCGCC
     AGAATGCAGA
6951 CCAGTGCTGC CCCGAGTATG AGTGTGTGTG TGACCCAGTG
     AGCTGTGACC
7001 TGCCCCCAGT GCCTCACTGT GAACGTGGCC TCCAGCCCAC
     ACTGACCAAC
7051 CCTGGCGAGT GCAGACCCAA CTTCACCTGC GCCTGCAGGA
     AGGAGGAGTG
7101 CAAAAGAGTG TCCCCACCCT CCTGCCCCCC GCACCGTTTG
     CCCACCCTTC
7151 GGAAGACCCA GTGCTGTGAT GAGTATGAGT GTGCCTGCAA
     CTGTGTCAAC
7201 TCCACAGTGA GCTGTCCCCT TGGGTACTTG GCCTCAACCG
     CCACCAATGA
7251 CTGTGGCTGT ACCACAACCA CCTGCCTTCC CGACAAGGTG
     TGTGTCCACC
7301 GAAGCACCAT CTACCCTGTG GGCCAGTTCT GGGAGGAGGG
     CTGCGATGTG
7351 TGCACCTGCA CCGACATGGA GGATGCCGTG ATGGGCCTCC
     GCGTGGCCCA
```

TABLE 1-continued

VWF Sequences

VWF domains

```
7401 GTGCTCCCAG AAGCCCTGTG AGGACAGCTG TCGGTCGGGC
     TTCACTTACG
7451 TTCTGCATGA AGGCGAGTGC TGTGGAAGGT GCCTGCCATC
     TGCCTGTGAG
7501 GTGGTGACTG GCTCACCGCG GGGGGACTCC CAGTCTTCCT
     GGAAGAGTGT
7551 CGGCTCCCAG TGGGCCTCCC CGGAGAACCC CTGCCTCATC
     AATGAGTGTG
7601 TCCGAGTGAA GGAGGAGGTC TTTATACAAC AAAGGAACGT
     CTCCTGCCCC
7651 CAGCTGGAGG TCCCTGTCTG CCCCTCGGGC TTTCAGCTGA
     GCTGTAAGAC
7701 CTCAGCGTGC TGCCCAAGCT GTCGCTGTGA GCGCATGGAG
     GCCTGCATGC
7751 TCAATGGCAC TGTCATTGGG CCCGGGAAGA CTGTGATGAT
     CGATGTGTGC
7801 ACGACCTGCC GCTGCATGGT GCAGGTGGGG GTCATCTCTG
     GATTCAAGCT
7851 GGAGTGCAGG AAGACCACCT GCAACCCCTG CCCCCTGGGT
     TACAAGGAAG
7901 AAAATAACAC AGGTGAATGT TGTGGGAGAT GTTTGCCTAC
     GGCTTGCACC
7951 ATTCAGCTAA GAGGAGGACA GATCATGACA CTGAAGCGTG
     ATGAGACGCT
8001 CCAGGATGGC TGTGATACTC ACTTCTGCAA GGTCAATGAG
     AGAGGAGAGT
8051 ACTTCTGGGA GAAGAGGGTC ACAGGCTGCC CACCCTTTGA
     TGAACACAAG
8101 TGTCTTGCTG AGGGAGGTAA AATTATGAAA ATTCCAGGCA
     CCTGCTGTGA
8151 CACATGTGAG GAGCCTGAGT GCAACGACAT CACTGCCAGG
     CTGCAGTATG
8201 TCAAGGTGGG AAGCTGTAAG TCTGAAGTAG AGGTGGATAT
     CCACTACTGC
8251 CAGGGCAAAT GTGCCAGCAA AGCCATGTAC TCCATTGACA
     TCAACGATGT
8301 GCAGGACCAG TGCTCCTGCT GCTCTCCGAC ACGGACGGAG
     CCCATGCAGG
8351 TGGCCCTGCA CTGCACCAAT GGCTCTGTTG TGTACCATGA
     GGTTCTCAAT
8401 GCCATGGAGT GCAAATGCTC CCCCAGGAAG TGCAGCAAGT
     GA
```

The VWF protein as used herein can be a VWF fragment comprising a D' domain and a D3 domain of VWF, wherein the VWF fragment binds to Factor VIII (FVIII) and inhibits binding of endogenous VWF (full-length VWF) to FVIII. The VWF fragment comprising the D' domain and the D3 domain can further comprise a VWF domain selected from the group consisting of an A1 domain, an A2 domain, an A3 domain, a D1 domain, a D2 domain, a D4 domain, a B1 domain, a B2 domain, a B3 domain, a C1 domain, a C2 domain, a CK domain, one or more fragments thereof, and any combinations thereof. In one embodiment, a VWF fragment comprises, consists essentially of, or consists of: (1) the D' and D3 domains of VWF or fragments thereof; (2) the D1, D', and D3 domains of VWF or fragments thereof; (3) the D2, D', and D3 domains of VWF or fragments thereof; (4) the D1, D2, D', and D3 domains of VWF or fragments thereof; or (5) the D1, D2, D', D3, and A1 domains of VWF or fragments thereof. The VWF fragment described herein does not contain a site binding to a VWF clearance receptor. In another embodiment, the VWF fragment described herein is not amino acids 764 to 1274 of SEQ ID NO: 21. The VWF fragment of the present invention can comprise any other sequences linked to or fused to the VWF fragment. For example, a VWF fragment described herein can further comprise a signal peptide.

In one embodiment, the VWF fragment comprising a D' domain and a D3 domain binds to or is associated with a FVIII protein. By binding to or associating with a FVIII protein, a VWF fragment of the invention protects FVIII from protease cleavage and FVIII activation, stabilizes the heavy chain and light chain of FVIII, and prevents clearance of FVIII by scavenger receptors. In another embodiment, the VWF fragment binds to or associates with a FVIII protein and blocks or prevents binding of the FVIII protein to phospholipid and activated Protein C. By preventing or inhibiting binding of the FVIII protein with endogenous, full-length VWF, the VWF fragment of the invention reduces the clearance of FVIII by VWF clearance receptors and thus extends half-life of the chimeric protein. The half-life extension of a chimeric protein is thus due to the binding of or associating with the VWF fragment lacking a VWF clearance receptor binding site to the FVIII protein and shielding or protecting of the FVIII protein by the VWF fragment from endogenous VWF which contains the VWF clearance receptor binding site. The FVIII protein bound to or protected by the VWF fragment can also allow recycling of a FVIII protein. By eliminating the VWF clearance pathway receptor binding sites contained in the full length VWF molecule, the FVIII/VWF heterodimers of the invention are shielded from the VWF clearance pathway, further extending FVIII half-life.

In one embodiment, a VWF protein useful for the present invention comprises a D' domain and a D3 domain of VWF, wherein the D' domain is at least 60%, 70%, 80%, 85%, 90%, 95%, 96%, 97%, 98%, 99%, or 100% identical to amino acids 764 to 866 of SEQ ID NO: 21, wherein the VWF protein prevents or inhibits binding of endogenous VWF to FVIII. In another embodiment, a VWF protein comprises the D' domain and the D3 domain of VWF, wherein the D3 domain is at least 60%, 70%, 80%, 85%, 90%, 95%, 96%, 97%, 98%, 99%, or 100% identical to amino acids 867 to 1240 of SEQ ID NO: 21, wherein the VWF protein prevents or inhibits binding of endogenous VWF to FVIII. In some embodiments, a VWF protein described herein comprises, consists essentially of, or consists of the D' domain and D3 domain of VWF, which are at least 60%, 70%, 80%, 85%, 90%, 95%, 96%, 97%, 98%, 99%, or 100% identical to amino acids 764 to 1240 of SEQ ID NO: 21, wherein the VWF protein prevents or inhibits binding of endogenous VWF to FVIII. In other embodiments, a VWF protein comprises, consists essentially of, or consists of the D1, D2, D', and D3 domains at least 60%, 70%, 80%, 85%, 90%, 95%, 96%, 97%, 98%, 99%, or 100% identical to amino acids 23 to 1240 of SEQ ID NO: 21, wherein the VWF protein prevents or inhibits binding of endogenous VWF to FVIII. In still other embodiments, the VWF protein further comprises a signal peptide operably linked thereto.

In some embodiments, a VWF protein useful for the invention consists essentially of or consists of (1) the D'D3 domain, the D1D'D3 domain, D2D'D3 domain, or D1D2D'D3 domain and (2) an additional VWF sequence up to about 10 amino acids (e.g., any sequences from amino acids 764 to 1240 of SEQ ID NO: 21 to amino acids 764 to 1250 of SEQ ID NO: 21), up to about 15 amino acids (e.g., any sequences from amino acids 764 to 1240 of SEQ ID NO: 21 to amino acids 764 to 1255 of SEQ ID NO: 21), up to about 20 amino acids (e.g., any sequences from amino acids 764 to 1240 of SEQ ID NO: 21 to amino acids 764 to 1260 of SEQ ID NO: 21), up to about 25 amino acids (e.g., any sequences from amino acids 764 to 1240 of SEQ ID NO: 21 to amino acids 764 to 1265 of SEQ ID NO: 21), or up to about 30 amino acids (e.g., any sequences from amino acids 764 to 1240 of SEQ ID NO: 21 to amino acids 764 to 1260 of SEQ ID NO: 21). In a particular embodiment, the VWF protein comprising or consisting essentially of the D' domain and the D3 domain is neither amino acids 764 to 1274 of SEQ ID NO: 21 nor the full-length mature VWF. In some embodiments, the D1D2 domain is expressed in trans with the D'D3 domain. In some embodiments, the D1D2 domain is expressed in cis with the D'D3 domain.

In other embodiments, the VWF protein comprising the D'D3 domains linked to the D1D2 domains further comprises an intracellular cleavage site, e.g., (a cleavage site by PACE (furin) or PC5), allowing cleavage of the D1D2 domains from the D'D3 domains upon expression. Non-limiting examples of the intracellular cleavage site are disclosed elsewhere herein.

In yet other embodiments, a VWF protein comprises a D' domain and a D3 domain, but does not comprise an amino acid sequence selected from the group consisting of (1) amino acids 1241 to 2813 corresponding to SEQ ID NO: 21, (2) amino acids 1270 to amino acids 2813 corresponding to SEQ ID NO: 21, (3) amino acids 1271 to amino acids 2813 corresponding to SEQ ID NO: 21, (4) amino acids 1272 to amino acids 2813 corresponding to SEQ ID NO: 21, (5) amino acids 1273 to amino acids 2813 corresponding to SEQ ID NO: 21, (6) amino acids 1274 to amino acids 2813 corresponding to SEQ ID NO: 21, and any combinations thereof.

In still other embodiments, a VWF protein of the present invention comprises, consists essentially of, or consists of an amino acid sequence corresponding to the D' domain, D3 domain, and A1 domain, wherein the amino acid sequence is at least 60%, 70%, 75%, 80%, 85%, 90%, 95%, 96%, 97%, 98%, 99%, or 100% identical to amino acid 764 to 1479 of SEQ ID NO: 21, wherein the VWF protein prevents binding of endogenous VWF to FVIII. In a particular embodiment, the VWF protein is not amino acids 764 to 1274 of SEQ ID NO: 21.

In some embodiments, a VWF protein of the invention comprises a D' domain and a D3 domain, but does not comprise at least one VWF domain selected from the group consisting of (1) an A1 domain, (2) an A2 domain, (3) an A3 domain, (4) a D4 domain, (5) a B1 domain, (6) a B2 domain, (7) a B3 domain, (8) a C1 domain, (9) a C2 domain, (10) a CK domain, (11) a CK domain and C2 domain, (12) a CK domain, a C2 domain, and a C1 domain, (13) a CK domain, a C2 domain, a C1 domain, a B3 domain, (14) a CK domain, a C2 domain, a C1 domain, a B3 domain, a B2 domain, (15) a CK domain, a C2 domain, a C1 domain, a B3 domain, a B2 domain, and a B1 domain, (16) a CK domain, a C2 domain, a C1 domain, a B3 domain, a B2 domain, a B1 domain, and a D4 domain, (17) a CK domain, a C2 domain, a C1 domain, a B3 domain, a B2 domain, a B1 domain, a D4 domain, and an A3 domain, (18) a CK domain, a C2 domain, a C1 domain, a B3 domain, a B2 domain, a B1 domain, a D4 domain, an A3 domain, and an A2 domain, (19) a CK domain, a C2 domain, a C1 domain, a B3 domain, a B2 domain, a B1 domain, a D4 domain, an A3 domain, an A2 domain, and an A1 domain, and (20) any combinations thereof.

In yet other embodiments, the VWF protein comprises the D'D3 domains and one or more domains or modules. Examples of such domains or modules include, but are not limited to, the domains and modules disclosed in Zhour et al., Blood published online Apr. 6, 2012: DOI 10.1182/blood-2012-01-405134, which is incorporated herein by reference in its entirety. For example, the VWF protein can comprise the D'D3 domain and one or more domains or modules selected from the group consisting of A1 domain, A2 domain, A3 domain, D4N module, VWD4 module, C8-4 module, TIL-4 module, C1 module, C2 module, C3 module, C4 module, C5 module, C5 module, C6 module, and any combinations thereof.

In still other embodiments, the VWF protein is linked to a heterologous moiety, wherein the heterologous moiety is linked to the N-terminus or the C-terminus of the VWF protein or inserted immediately downstream of one or more amino acids (e.g., one or more XTEN insertion sites) in the VWF protein. For example, the insertion sites for the heterologous moiety in the VWF protein can be in the D' domain, the D3 domain, or both. The heterologous moiety can be a half-life extender.

In certain embodiments, a VWF protein useful for the invention forms a multimer, e.g., dimer, trimer, tetramer, pentamer, hexamer, heptamer, or the higher order multimers. In other embodiments, the VWF protein is a monomer having only one VWF protein. In some embodiments, the VWF protein of the present invention can have one or more amino acid substitutions, deletions, additions, or modifications. In one embodiment, the VWF protein can include amino acid substitutions, deletions, additions, or modifications such that the VWF protein is not capable of forming a disulfide bond or forming a dimer or a multimer. In another embodiment, the amino acid substitution is within the D' domain and the D3 domain. In a particular embodiment, a VWF protein useful for the invention contains at least one amino acid substitution at a residue corresponding to residue 1099, residue 1142, or both residues 1099 and 1142 corresponding to SEQ ID NO: 21. The at least one amino acid substitution can be any amino acids that are not occurring naturally in the wild type VWF. For example, the amino acid substitution can be any amino acids other than cysteine, e.g., Isoleucine, Alanine, Leucine, Asparagine, Lysine, Aspartic acid, Methionine, Phenylalanine, Glutamic acid, Threonine, Glutamine, Tryptophan, Glycine, Valine, Proline, Serine, Tyrosine, Arginine, or Histidine. In another example, the amino acid substitution has one or more amino acids that prevent or inhibit the VWF proteins from forming multimers.

In certain embodiments, the VWF protein useful herein can be further modified to improve its interaction with FVIII, e.g., to improve binding affinity to FVIII. As a non-limiting example, the VWF protein comprises a serine residue at the residue corresponding to amino acid 764 of SEQ ID NO: 21 and a lysine residue at the residue corresponding to amino acid 773 of SEQ ID NO: 21. Residues 764 and/or 773 can contribute to the binding affinity of the VWF proteins to FVIII. In other embodiments, The VWF proteins useful for the invention can have other modifications, e.g., the protein can be pegylated, glycosylated, hesylated, or polysialylated.

II. B. XTEN Sequences

As used herein "XTEN sequence" refers to extended length polypeptides with non-naturally occurring, substantially non-repetitive sequences that are composed mainly of small hydrophilic amino acids, with the sequence having a low degree or no secondary or tertiary structure under physiologic conditions. As a chimeric protein partner, XTENs can serve as a carrier, conferring certain desirable pharmacokinetic, physicochemical and pharmaceutical properties when linked to a VWF protein or a FVIII sequence of the invention to create a chimeric protein. Such desirable properties include but are not limited to enhanced pharmacokinetic parameters and solubility characteristics. As used herein, "XTEN" specifically excludes antibodies or antibody fragments such as single-chain antibodies or Fc fragments of a light chain or a heavy chain.

The present invention provides that a shorter XTEN sequence provides an improved half-life extending property compared to a longer XTEN sequence when the XTEN sequence is fused to a VWF protein and/or the second Ig constant region or a portion thereof. Therefore, the XTEN sequence fused to a VWF protein and/or the second Ig constant region or a portion thereof contains less than 288 amino acids in length, i.e., is shorter than 288 amino acids. In one embodiment, the XTEN sequence fused to a VWF protein and/or the second Ig constant region or a portion thereof consists of an amino acid sequence having a length of between 12 amino acids and 287 amino acids. In another embodiment, the XTEN sequence fused to a VWF protein and/or the second Ig constant region or a portion thereof comprise at least about 36 amino acids, at least about 42 amino acids, at least about 72 amino acids, or at least about 144 amino acids, but less than 288 amino acids. In other embodiments, the XTEN sequence fused to a VWF protein and/or the second Ig constant region or a portion thereof is selected from AE36, AG36, AE42, AG42, AE72, AG72, AE144, or AG144. In one embodiment, the XTEN sequence fused to a VWF protein and/or the second Ig constant region or a portion thereof is an amino acid sequence at least 80%, 85%, 90%, 95%, 96%, 97%, 98%, 99%, or 100% identical to SEQ ID NO: 9, SEQ ID NO: 10, SEQ ID NO: 11, or SEQ ID NO: 14, wherein the chimeric protein exhibits an improved half-life compared to a chimeric protein without the XTEN sequence.

The chimeric protein of the invention can further comprise an additional (second, third, or more) XTEN sequences. The additional XTEN sequence can further be fused to the FVIII protein or the first Ig constant region or a portion thereof. The additional XTEN sequences can be any length. For example, the additional XTEN sequence fused to the FVIII protein or the first Ig constant region or a portion thereof is a peptide or a polypeptide having greater than about 20, 30, 40, 50, 60, 70, 80, 90, 100, 150, 200, 250, 300, 350, 400, 450, 500, 550, 600, 650, 700, 750, 800, 850, 900, 950, 1000, 1200, 1400, 1600, 1800, or 2000 amino acid residues. In certain embodiments, the additional XTEN sequence is a peptide or a polypeptide having greater than about 20 to about 3000 amino acid residues, greater than about 30 to about 2500 residues, greater than about 40 to about 2000 residues, greater than about 50 to about 1500 residues, greater than about 60 to about 1000 residues, greater than about 70 to about 900 residues, greater than about 80 to about 800 residues, greater than about 90 to about 700 residues, greater than about 100 to about 600 residues, greater than about 110 to about 500 residues, or greater than about 120 to about 400 residues.

The XTEN sequences (i.e., the XTEN sequence fused to the VWF protein and/or the second Ig constant region or a portion thereof or the XTEN sequence fused to the FVIII protein and/or the first Ig constant region or a portion thereof or inserted at one or more insertion sites within the FVIII protein) can comprise one or more sequence motif of 9 to 14 amino acid residues or an amino acid sequence at least 80%, 90%, 91%, 92%, 93%, 94%, 95%, 96%, 97%, 98%, or 99% identical to the sequence motif, wherein the motif comprises, consists essentially of, or consists of 4 to 6 types of amino acids selected from the group consisting of glycine (G), alanine (A), serine (S), threonine (T), glutamate (E) and proline (P). See US 2010-0239554 A1.

In some embodiments, the XTEN sequence comprises non-overlapping sequence motifs in which at least about 80%, or at least about 85%, or at least about 90%, or at least about 91%, or at least about 92%, or at least about 93%, or at least about 94%, or at least about 95%, or at least about 96%, or at least about 97%, or at least about 98%, or at least about 99% or about 100% of the sequence consists of multiple units of non-overlapping sequences selected from a single motif family selected from Table 2A, resulting in a family sequence. As used herein, "family" means that the XTEN has motifs selected only from a single motif category from Table 2A; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to FVIII or VWF. In some embodiments of XTEN families, an XTEN sequence comprises multiple units of non-overlapping sequence motifs of the AD motif family, or of the AE motif family, or of the AF motif family, or of the AG motif family, or of the AM motif family, or of the AQ motif family, or of the BC family, or of the BD family, with the resulting XTEN exhibiting the range of homology described above. In other embodiments, the XTEN comprises multiple units of motif sequences from two or more of the motif families of Table 2A. These sequences can be selected to achieve desired physical/chemical characteristics, including such properties as net charge, hydrophilicity, lack of secondary structure, or lack of repetitiveness that are conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues.

TABLE 2A

XTEN Sequence Motifs of 12 Amino Acids and Motif Families

| Motif Family* | MOTIF SEQUENCE |
| --- | --- |
| AD | GESPGGSSGSES (SEQ ID NO: 24) |
| AD | GSEGSSGPGESS (SEQ ID NO: 25) |
| AD | GSSESGSSEGGP (SEQ ID NO: 26) |
| AD | GSGGEPSESGSS (SEQ ID NO: 27) |
| AE, AM | GSPAGSPTSTEE (SEQ ID NO: 28) |
| AE, AM, AQ | GSEPATSGSETP (SEQ ID NO: 29) |
| AE, AM, AQ | GTSESATPESGP (SEQ ID NO: 30) |
| AE, AM, AQ | GTSTEPSEGSAP (SEQ ID NO: 31) |
| AF, AM | GSTSESPSGTAP (SEQ ID NO: 32) |
| AF, AM | GTSTPESGSASP (SEQ ID NO: 33) |
| AF, AM | GTSPSGESSTAP (SEQ ID NO: 34) |
| AF, AM | GSTSSTAESPGP (SEQ ID NO: 35) |
| AG, AM | GTPGSGTASSSP (SEQ ID NO: 36) |
| AG, AM | GSSTPSGATGSP (SEQ ID NO: 37) |
| AG, AM | GSSPSASTGTGP (SEQ ID NO: 38) |
| AG, AM | GASPGTSSTGSP (SEQ ID NO: 39) |
| AQ | GEPAGSPTSTSE (SEQ ID NO: 40) |
| AQ | GTGEPSSTPASE (SEQ ID NO: 41) |
| AQ | GSGPSTESAPTE (SEQ ID NO: 42) |
| AQ | GSETPSGPSETA (SEQ ID NO: 43) |
| AQ | GPSETSTSEPGA (SEQ ID NO: 44) |
| AQ | GSPSEPTEGTSA (SEQ ID NO: 45) |
| BC | GSGASEPTSTEP (SEQ ID NO: 46) |

TABLE 2A-continued

XTEN Sequence Motifs of 12 Amino Acids and Motif Families

| Motif Family* | MOTIF SEQUENCE |
| --- | --- |
| BC | GSEPATSGTEPS (SEQ ID NO: 47) |
| BC | GTSEPSTSEPGA (SEQ ID NO: 48) |
| BC | GTSTEPSEPGSA (SEQ ID NO: 49) |
| BD | GSTAGSETSTEA (SEQ ID NO: 50) |
| BD | GSETATSGSETA (SEQ ID NO: 51) |
| BD | GTSESATSESGA (SEQ ID NO: 52) |
| BD | GTSTEASEGSAS (SEQ ID NO: 53) |

*Denotes individual motif sequences that, when used together in various permutations, results in a "family sequence"

In some embodiments, the XTEN sequence used in the invention is at least 60%, 70%, 80%, 85%, 90%, 91%, 92%, 93%, 94%, 95%, 96%, 97%, 98%, 99%, or 100% identical to a sequence selected from the group consisting of AE42, AG42, AE48, AM48, AE72, AG72, AE108, AG108, AE144, AF144, AG144, AE180, AG180, AE216, AG216, AE252, AG252, AE288, AG288, AE324, AG324, AE360, AG360, AE396, AG396, AE432, AG432, AE468, AG468, AE504, AG504, AF504, AE540, AG540, AF540, AD576, AE576, AF576, AG576, AE612, AG612, AE624, AE648, AG648, AG684, AE720, AG720, AE756, AG756, AE792, AG792, AE828, AG828, AD836, AE864, AF864, AG864, AM875, AE912, AM923, AM1318, BC864, BD864, AE948, AE1044, AE1140, AE1236, AE1332, AE1428, AE1524, AE1620, AE1716, AE1812, AE1908, AE2004A, AG948, AG1044, AG1140, AG1236, AG1332, AG1428, AG1524, AG1620, AG1716, AG1812, AG1908, and AG2004. See US 2010-0239554 A1.

In one embodiment, the XTEN sequence is at least 60%, 70%, 80%, 90%, 95%, 96%, 97%, 98%, 99% or 100% identical to an amino acid sequence selected from the group consisting of AE42 (SEQ ID NO: 9), AE72 (SEQ ID NO: 10), AE144_2A (SEQ IDNO: 55), AE144_3B (SEQ ID NO: 56), AE144_4A (SEQ ID NO: 57), AE144_5A (SEQ ID NO: 58), AE144_6B (SEQ ID NO: 59), AG144_A (SEQ ID NO: 60), AG144_B (SEQ ID NO: 61), AG144_C (SEQ ID NO: 62), AG144_F (SEQ IDNO: 63), AE864 (SEQ ID NO: 15), AE576 (SEQ ID NO: 16), AE288 (SEQ ID NO: 8), AE288_2 (SEQ ID NO: 54), AE144 (SEQ ID NO: 11), AG864 (SEQ ID NO: 17), AG576 (SEQ ID NO: 18), AG288 (SEQ ID NO: 19), AG144 (SEQ ID NO: 14), and any combinations thereof. In another embodiment, the XTEN sequence is selected from the group consisting of AE42 (SEQ ID NO: 9), AE72 (SEQ ID NO: 10), AE144_2A (SEQ IDNO: 55), AE144_3B (SEQ ID NO: 56), AE144_4A (SEQ ID NO: 57), AE144_5A (SEQ IDNO: 58), AE144_6B (SEQ ID NO: 59), AG144_A (SEQ ID NO: 60), AG144_B (SEQ ID NO: 61), AG144_C (SEQ ID NO: 62), AG144_F (SEQ IDNO: 63), AE864 (SEQ ID NO: 15), AE576 (SEQ ID NO: 16), AE288 (SEQ ID NO: 8), AE288_2 (SEQ ID NO: 54), AE144 (SEQ ID NO: 11), AG864 (SEQ ID NO: 17), AG576 (SEQ ID NO: 18), AG288 (SEQ ID NO: 19), AG144 (SEQ ID NO: 14), and any combinations thereof. In a specific embodiment, the XTEN sequence is AE288. The amino acid sequences for certain XTEN sequences of the invention are shown in Table 2B.

TABLE 2B

| XTEN | Amino Acid Sequence |
|---|---|
| AE42<br>SEQ ID NO: 9 | GAPGSPAGSPTSTEEGTSESATPESGPGSEPATSGSETPASS |
| AE72<br>SEQ ID NO: 10 | GAP TSESATPESG PGSEPATSGS ETPGTSESAT PESGPGSEPA TSGSETPGTS ESATPESGPG TSTEPSEGSA PGASS |
| AE144<br>SEQ ID NO: 11 | GSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESA PESGPGSEPATSGSETPGTSTEPSEGSAP |
| AE144_2A<br>(SEQ ID NO: 55) | TSTEPSEGSAPGSPAGSPTSTEEGTSTEPSEGSAPGTSTEPSEGSAPGTSESATPESGPGTS TEPSEGSAPGTSESATPESGPGSEPATSGSETPGTSTEPSEGSAPGTSTEPSEGSAPGTSES ATPESGPGTSESATPESGPG |
| AE144_3B<br>(SEQ ID NO: 56) | SPAGSPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGSPAG SPTSTEEGTSTEPSEGSAPG |
| AE144_4A<br>(SEQ ID NO: 57) | TSESATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEGTSES ATPESGPGTSTEPSEGSAPG |
| AE144_5A<br>(SEQ ID NO: 58) | TSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAG SPTSTEEGSPAGSPTSTEEG |
| AE144_6B<br>(SEQ ID NO: 59) | TSTEPSEGSAPGTSESATPESGPGTSESATPESGPGTSESATPESGPGSEPATSGSETPGSE PATSGSETPGSPAGSPTSTEEGTSTEPSEGSAPGTSTEPSEGSAPGSEPATSGSETPGTSES ATPESGPGTSTEPSEGSAPG |
| AG144<br>SEQ ID NO: 14 | GTPGSGTASSSPGSSTPSGATGSPGSSPSASTGTGPGSSPSASTGTGPGASPGTSST GSPGASPGTSSTGSPGSSTPSGATGSPGSSPSASTGTGPGASPGTSSTGSPGSSPSA STGTGPGTPGSGTASSSPGSSTPSGATGSP |
| AG144_A<br>(SEQ ID NO: 60) | GASPGTSSTGSPGSSPSASTGTGPGSSPSASTGTGPGTPGSGTASSSPGSSTPSGATGSPGS SPSASTGTGPGASPGTSSTGSPGTPGSGTASSSPGSSTPSGATGSPGTPGSGTASSSPGASP GTSSTGSPGASPGTSSTGSP |
| AG144_B<br>(SEQ ID NO: 61) | GTPGSGTASSSPGSSTPSGATGSPGASPGTSSTGSPGTPGSGTASSSPGSSTPSGATGSPGS SPSASTGTGPGSSPSASTGTGPGSSTPSGATGSPGSSTPSGATGSPGASPGTSSTGSPGASP GTSSTGSPGASPGTSSTGSP |
| AG144_C<br>(SEQ ID NO: 62) | GTPGSGTASSSPGASPGTSSTGSPGASPGTSSTGSPGASPGTSSTGSPGSSPSASTGTGPGT PGSGTASSSPGASPGTSSTGSPGASPGTSSTGSPGASPGTSSTGSPGSSTPSGATGSPGSST PSGATGSPGASPGTSSTGSP |
| AG144_F<br>(SEQ ID NO: 63) | GSSPSASTGTGPGSSPSASTGTGPGASPGTSSTGSPGASPGTSSTGSPGSSTPSGATGSPGS SPSASTGTGPGASPGTSSTGSPGSSPSASTGTGPGTPGSGTASSSPGSSTPSGATGSPGSST PSGATGSPGASPGTSSTGSP |
| AE288<br>SEQ ID NO: 8 | GTSESATPESGPGSEPATSGSETPGTSESATPESGPGSEPATSGSETPGTSESATPESG PGTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATPE SGPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAP |
| AE288_2<br>(SEQ ID NO: 54) | GSPAGSPTSTEEGTSESATPESGPGSEPATSGSETPGTSESATPESGPGTSTEPSEGSAPGT STEPSEGSAPGTSTEPSEGSAPGTSTEPSEGSAPGTSTEPSEGSAPGTSTEPSEGSAPGSPA GSPTSTEEGTSTEPSEGSAPGTSESATPESGPGSEPATSGSETPGTSESATPESGPGSEPAT SGSETPGTSESATPESGPGTSTEPSEGSAPGTSESATPESGPGAGSPTSTEEGSPAGSPT STEEGSPAGSPTSTEEGTSESATPESGPGTSTEPSEGSAP |
| AG288<br>SEQ ID NO: 19 | PGASPGTSSTGSPGASPGTSSTGSPGTPGSGTASSSPGSSTPSGATGSPGTPGSGTASS SPGSSTPSGATGSPGTPGSGTASSSPGSSTPSGATGSPGSSTPSGATGSPGSSPSASTG TGPGSSPSASTGTGPGASPGTSSTGSPGTPGSGTASSSPGSSTPSGATGSPGSSPSAST GTGPGSSPSASTGTGPGASPGTSSTGSPGASPGTSSTGSPGSSTPSGATGSPGSSPSAS TGTGPGASPGTSSTGSPGSSPSASTGTGPGTPGSGTASSSPGSSTPSGATGS |
| AE576<br>SEQ ID NO: 16 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSESATPESGPGTSTEPSEG SAPGTSTEPSEGSAPGTSESATPESGPGTSTEPSEGSAPGTSESATPESGPGSEPATSG SETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP |

TABLE 2B-continued

XTEN Sequences

| XTEN | Amino Acid Sequence |
|---|---|
| | ATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAP |
| AG576<br>SEQ ID NO: 18 | PGTPGSGTASSSPGSSTPSGATGSPGSSPSASTGTGPGSSPSASTGTGPGSSTPSGATG<br>SPGSSTPSGATGSPGASPGTSSTGSPGASPGTSSTGSPGASPGTSSTGSPGTPGSGTAS<br>SSPGASPGTSSTGSPGASPGTSSTGSPGASPGTSSTGSPGSSPSASTGTGPGTPGSGTA<br>SSSPGASPGTSSTGSPGASPGTSSTGSPGASPGTSSTGSPGSSTPSGATGSPGSSTPSG<br>ATGSPGASPGTSSTGSPGTPGSGTASSSPGSSTPSGATGSPGSSTPSGATGSPGSSTPS<br>GATGSPGSSPSASTGTGPGASPGTSSTGSPGASPGTSSTGSPGTPGSGTASSSPGASPG<br>TSSTGSPGASPGTSSTGSPGASPGTSSTGSPGASPGTSSTGSPGTPGSGTASSSPGSST<br>PSGATGSPGTPGSGTASSSPGSSTPSGATGSPGTPGSGTASSSPGSSTPSGATGSPGSS<br>TPSGATGSPGSSPSASTGTGPGSSPSASTGTGPGASPGTSSTGSPGTPGSGTASSSPGS<br>STPSGATGSPGSSPSASTGTGPGSSPSASTGTGPGASPGTSSTGS |
| AE864<br>SEQ ID NO: 15 | GSPAGSPTSTEEGTSESATPESGPGTSTEPSEGSAPGSPAGSPTSTEEGTSTEPSEGSA<br>PGTSTEPSEGSAPGTSESATPESGPGSEPATSGSETPGSEPATSGSETPGSPAGSPTST<br>EEGTSESATPESGPGTSTEPSEGSAPGTSTEPSEGSAPGSPAGSPTSTEEGTSTEPSEG<br>SAPGTSTEPSEGSAPGTSESATPESGPGTSTEPSEGSAPGTSESATPESGPGSEPATSG<br>SETPGTSTEPSEGSAPGTSTEPSEGSAPGTSESATPESGPGTSESATPESGPGSPAGSP<br>TSTEEGTSESATPESGPGSEPATSGSETPGTSESATPESGPGTSTEPSEGSAPGTSTEP<br>SEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEP<br>ATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGS<br>EPATSGSETPGTSESATPESGPGSEPATSGSETPGTSESATPESGPGTSTEPSEGSAPG<br>SPAGSPTSTEEGTSESATPESGPGSEPATSGSETPGTSESATPESGPGSPAGSPTSTEE<br>GSPAGSPTSTEEGTSTEPSEGSAPGTSESATPESGPGTSESATPESGPGTSESATPESG<br>PGSEPATSGSETPGSEPATSGSETPGSPAGSPTSTEEGTSTEPSEGSAPGTSTEPSEGS<br>APGSEPATSGSETPGTSESATPESGPGTSTEPSEGSAP |
| AG864<br>SEQ ID NO: 17 | GASPGTSSTGSPGSSPSASTGTGPGSSPSASTGTGPGTPGSGTASSSPGSSTPSGATGS<br>PGSSPSASTGTGPGASPGTSSTGSPGTPGSGTASSSPGSSTPSGATGSPGTPGSGTASS<br>SPGASPGTSSTGSPGASPGTSSTGSPGTPGSGTASSSPGSSTPSGATGSPGASPGTSST<br>GSPGTPGSGTASSSPGSSTPSGATGSPGSSPSASTGTGPGSSPSASTGTGPGSSTPSGA<br>TGSPGSSTPSGATGSPGASPGTSSTGSPGASPGTSSTGSPGASPGTSSTGSPGTPGSGT<br>ASSSPGASPGTSSTGSPGASPGTSSTGSPGASPGTSSTGSPGSSPSASTGTGPGTPGSG<br>TASSSPGASPGTSSTGSPGASPGTSSTGSPGASPGTSSTGSPGSSTPSGATGSPGSSTP<br>SGATGSPGASPGTSSTGSPGTPGSGTASSSPGSSTPSGATGSPGSSTPSGATGSPGSST<br>PSGATGSPGSSPSASTGTGPGASPGTSSTGSPGASPGTSSTGSPGTPGSGTASSSPGAS<br>PGTSSTGSPGASPGTSSTGSPGASPGTSSTGSPGASPGTSSTGSPGTPGSGTASSSPGS<br>STPSGATGSPGTPGSGTASSSPGSSTPSGATGSPGTPGSGTASSSPGSSTPSGATGSPG<br>SSTPSGATGSPGSSPSASTGTGPGSSPSASTGTGPGASPGTSSTGSPGTPGSGTASSSP<br>GSSTPSGATGSPGSSPSASTGTGPGSSPSASTGTGPGASPGTSSTGSPGASPGTSSTGS<br>PGSSTPSGATGSPGSSPSASTGTGPGASPGTSSTGSPGSSPSASTGTGPGTPGSGTASS<br>SPGSSTPSGATGSPGSSTPSGATGSPGASPGTSSTGSP |

In those embodiments wherein the XTEN component(s) have less than 100% of its amino acids consisting of 4, 5, or 6 types of amino acid selected from glycine (G), alanine (A), serine (S), threonine (T), glutamate (E) and proline (P), or less than 100% of the sequence consisting of the sequence motifs from Table 3 or the XTEN sequences of Tables 4, and 13-17, the other amino acid residues of the XTEN are selected from any of the other 14 natural L-amino acids, but are preferentially selected from hydrophilic amino acids such that the XTEN sequence contains at least about 90%, 91%, 92%, 93%, 94%, 95%, 96%, 97%, 98%, or at least about 99% hydrophilic amino acids. The XTEN amino acids that are not glycine (G), alanine (A), serine (S), threonine (T), glutamate (E) and proline (P) are either interspersed throughout the XTEN sequence, are located within or between the sequence motifs, or are concentrated in one or more short stretches of the XTEN sequence, e.g., to create a linker between the XTEN and the FVIII or VWF components. In such cases where the XTEN component comprises amino acids other than glycine (G), alanine (A), serine (S), threonine (T), glutamate (E) and proline (P), it is preferred that less than about 2% or less than about 1% of the amino acids be hydrophobic residues such that the resulting sequences generally lack secondary structure, e.g., not having more than 2% alpha helices or 2% beta-sheets, as determined by the methods disclosed herein. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: cysteine (to avoid disulfide formation and oxidation), methionine (to avoid oxidation), asparagine and glutamine (to avoid desamidation). Thus, in some embodiments, the XTEN component comprising other amino acids in addition to glycine (G), alanine (A), serine (S), threonine (T), glutamate (E) and proline (P) have a sequence with less than 5% of the residues contributing to alpha-helices and beta-sheets as measured by the Chou- Fasman algorithm and have at least 90%, or at least about 95% or more random coil formation as measured by the GOR algorithm.

In further embodiments, the XTEN sequence used in the invention affects the physical or chemical property, e.g., pharmacokinetics, of the chimeric protein of the present invention. The XTEN sequence used in the present invention can exhibit one or more of the following advantageous properties: conformational flexibility, enhanced aqueous solubility, high degree of protease resistance, low immunogenicity, low binding to mammalian receptors, or increased hydrodynamic (or Stokes) radii. In a specific embodiment, the XTEN sequence linked to a FVIII protein in this invention increases pharmacokinetic properties such as longer terminal half-life or increased area under the curve (AUC), so that the chimeric protein described herein stays in vivo for an increased period of time compared to wild type FVIII. In further embodiments, the XTEN sequence used in this invention increases pharmacokinetic properties such as longer terminal half-life or increased area under the curve (AUC), so that FVIII protein stays in vivo for an increased period of time compared to wild type FVIII.

One embodiment of the present invention is a FVIII/VWF fusion protein comprising a FVIII portion fused to an Fc region and a VWF portion fused to an Fc region, wherein an XTEN sequence (e.g., AE288) is inserted within the FVIII portion, and wherein an XTEN sequence having less than 288 amino acids (e.g., AE144) is inserted between the VWF portion and the Fc portion. As described in the examples, insertion of an XTEN having less than 288 amino acids between the VWF portion and the Fc portion has a greater effect on the pharmacokinetics of the chimeric protein than the insertion of an XTEN having 288 amino acids between the VWF portion and the Fc portion. For example, insertion of an XTEN sequence having less than 288 amino acids between the VWF portion and the Fc portion in FVIII/VWF fusion protein can increase the terminal half-life of the chimeric protein compared to an XTEN having 288 amino acids. In some embodiments, the terminal half-life is increased by at least about 5%, at least about 10%, at least about 15%, at least about 20%, at least about 25%, or at least about 30%, relative to the insertion of an XTEN sequence having 288 amino acids. In one particular embodiment, the terminal half-life is increased by at least about 35% relative to the insertion of an XTEN having 288 amino acids. Insertion of an XTEN sequence having less than 288 amino acids can also increase the AUC value of the chimeric protein. In some embodiments, AUC is increased by at least about 50%, at least about 100%, or at least about 200% relative to the insertion of an XTEN having 288 amino acids. In one particular embodiment, AUC is increased by about two-fold. Insertion of an XTEN sequence having less than 288 amino acids can also reduce the clearance of the chimeric protein. For example, clearance can be decreased by at least about 5%, at least about 10%, at least about 15%, at least about 20%, at least about 25%, or at least about 30%, relative to the insertion of an XTEN sequence having 288 amino acids. Insertion of an XTEN sequence having less than 288 amino acids can increase mean residence time (MRT) and/or decrease the apparent volume of distribution at steady state (Vss) relative to the insertion of an XTEN having 288 amino acids.

A variety of methods and assays can be employed to determine the physical/chemical properties of proteins comprising the XTEN sequence. Such methods include, but are not limited to analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Amau et al., *Prot Expr and Purif* 48, 1-13 (2006).

Additional examples of XTEN sequences that can be used according to the present invention and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, or WO 20130122617 A1.

II.C. Factor VIII (FVIII) Protein

"A FVIII protein" as used herein means a functional FVIII polypeptide in its normal role in coagulation, unless otherwise specified. The term a FVIII protein includes a functional fragment, variant, analog, or derivative thereof that retains the function of full-length wild-type Factor VIII in the coagulation pathway. "A FVIII protein" is used interchangeably with FVIII polypeptide (or protein) or FVIII. Examples of the FVIII functions include, but not limited to, an ability to activate coagulation, an ability to act as a cofactor for factor IX, or an ability to form a tenase complex with factor IX in the presence of $Ca^{2+}$ and phospholipids, which then converts Factor X to the activated form Xa. The FVIII protein can be the human, porcine, canine, rat, or murine FVIII protein. In addition, comparisons between FVIII from humans and other species have identified conserved residues that are likely to be required for function (Cameron et al., *Thromb. Haemost.* 79:317-22 (1998); U.S. Pat. No. 6,251,632).

A number of tests are available to assess the function of the coagulation system: activated partial thromboplastin time (aPTT) test, chromogenic assay, ROTEM assay, prothrombin time (PT) test (also used to determine INR), fibrinogen testing (often by the Clauss method), platelet count, platelet function testing (often by PFA-100), TCT, bleeding time, mixing test (whether an abnormality corrects if the patient's plasma is mixed with normal plasma), coagulation factor assays, antiphospholipid antibodies, D-dimer, genetic tests (e.g., factor V Leiden, prothrombin mutation G20210A), dilute Russell's viper venom time (dRVVT), miscellaneous platelet function tests, thromboelastography (TEG or Sonoclot), thromboelastometry (TEM®, e.g., ROTEM®), or euglobulin lysis time (ELT).

The aPTT test is a performance indicator measuring the efficacy of both the "intrinsic" (also referred to the contact activation pathway) and the common coagulation pathways. This test is commonly used to measure clotting activity of commercially available recombinant clotting factors, e.g., FVIII or FIX. It is used in conjunction with prothrombin time (PT), which measures the extrinsic pathway.

ROTEM analysis provides information on the whole kinetics of haemostasis: clotting time, clot formation, clot stability and lysis. The different parameters in thromboelastometry are dependent on the activity of the plasmatic coagulation system, platelet function, fibrinolysis, or many factors which influence these interactions. This assay can provide a complete view of secondary haemostasis.

The FVIII polypeptide and polynucleotide sequences are known, as many functional fragments, mutants and modified versions. Examples of human FVIII sequences (full-length) are shown below.

TABLE 3

Amino Acid Sequence of Full-length Factor VIII (Full-length FVIII (FVIII signal peptide underlined; FVIII heavy chain
is double underlined; B domain is italicized; and FVIII light chain
in is plain text)

Signal Peptide: (SEQ ID NO: 64)
MQIELSTCFFLCLLRFCFS

Mature Factor VIII (SEQ ID NO: 65)*
ATRRYYLGAVELSWDYMQSDLGELPVDARFPPRVPKSFPFNTSVVYKKTLFVEFTDHLFNIAKPRPPWMGLL
GPTIQAEVYDTVVITLKNMASHPVSLHAVGVSYWKASEGAEYDDQTSQREKEDDKVFPGGSHTYVWQVLKEN
GPMASDPLCLTYSYLSHVDLVKDLNSGLIGALLVCREGSLAKEKTQTLHKFILLFAVFDEGKSWHSETKNSL
MQDRDAASARAWPKMHTVNGYVNRSLPGLIGCHRKSVYWHVIGMGTTPEVHSIFLEGHTFLVRNHRQASLEI
SPITFLTAQTLLMDLGQFLLFCHISSHQHDGMEAYVKVDSCPEEPQLRMKNNEEAEDYDDDLTDSEMDVVRF
DDDNSPSFIQIRSVAKKHPKTWVHYIAAEEEDWDYAPLVLAPDDRSYKSQYLNNGPQRIGRKYKKVRFMAYT
DETFKTREAIQHESGILGPLLYGEVGDTLLIIFKNQASRPYNIYPHGITDVRPLYSRRLPKGVKHLKDFPIL
PGEIFKYKWTVTVEDGPTKSDPRCLTRYYSSFVNMERDLASGLIGPLLICYKESVDQRGNQIMSDKRNVILF
SVFDENRSWYLTENIQRFLPNPAGVQLEDPEFQASNIMHSINGYVFDSLQLSVCLHEVAYWYILSIGAQTDF
LSVFFSGYTFKHKMVYEDTLTLFPFSGETVFMSMENPGLWILGCHNSDFRNRGMTALLKVSSCDKNTGDYYE
DSYEDISAYLLSKNNAIEPRSFSQNSRHPSTRQKQFNATTIPENDIEKTDPWFAHRTPMPKIQNVSSSDLLM
LLRQSPTPHGLSLSDLQEAKYETFSDDPSPGAIDSNNSLSEMTHFRPQLHHSGDMVFTPESGLQLRLNEKLG
TTAATELKKLDFKVSSTSNNLISTIPSDNLAAGTDNTSSLGPPSMPVHYDSQLDTTLFGKKSSPLTESGGPL
SLSEENNDSKLLESGLMNSQESSWGKNVSSTESGRLFKGKRAHGPALLTKDNALFKVSISLLKTNKTSNNSA
TNRKTHIDGPSLLIENSPSVWQNILESDTEFFKKVTPLIHDRMLMDKNATALRLNHMSNKTTSSKNMEMVQQK
KEGPIPPDAQNPDMSFFKMLFLPESARWIQRTHGKNSLNSGQGPSPKQLVSLGPEKSVEGQNFLSEKNKVVV
GKGEFTKDVGLKEMVFPSSRNLFLTNLDNLHENNTHNQEKKIQEEIEKKETLIQENVVLPQIHTVTGTKNFM
KNLFLLSTRQNVEGSYDGAYAPVLQDFRSLNDSTNRTKKHTAHFSKKGEEENLEGLGNQTKQIVEKYACTTR
ISPNTSQQNFVTQRSKRALKQFRLPLEETELEKRIIVDDTSTQWSKNMKHLTPSTLTQIDYNEKEKGAITQS
PLSDCLTRSHSIPQANRSPLPIAKVSSFPSIRPIYLTRVLFQDNSSHLPAASYRKKDSGVQESSHFLQGAKK
NNLSLAILTLEMTGDQREVGSLGTSATNSVTYKKVENTVLPKPDLPKTSGKVELLPKVHIYQKDLFPTETSN
GSPGHLDLVEGSLLQGTEGAIKWNEANRPGKVPFLRVATESSAKTPSKLLDPLAWDNHYGTQIPKEEWKSQE
KSPEKTAFKKKDTILSLNACESNHAIAAINEGQNKPEIEVTWAKQGRTERLCSQNPPVLKRHQREITRTTLQ
SDQEEIDYDDTISVEMKKEDFDIYDEDENQSPRSFQKKTRHYFIAAVERLWDYGMSSSPHVLRNRAQSGSVP
QFKKVVFQEFTDGSFTQPLYRGELNEHLGLLGPYIRAEVEDNIMVTFRNQASRPYSFYSSLISYEEDQRQGA
EPRKNFVKPNETKTYFWKVQHHMAPTKDEFDCKAWAYFSDVDLEKDVHSGLIGPLLVCHTNTLNPAHGRQVT
VQEFALFFTIFDETKSWYFTENMERNCRAPCNIQMEDPTFKENYRFHAINGYIMDTLPGLVMAQDQRIRWYL
LSMGSNENIHSIHFSGHVFTVRKKEEYKMALYNLYPGVFETVEMLPSKAGIWRVECLIGEHLHAGMSTLFLV
YSNKCQTPLGMASGHIRDFQITASGQYGQWAPKLARLHYSGSINAWSTKEPFSWIKVDLLAPMIIHGIKTQG
ARQKFSSLYISQFIIMYSLDGKKWQTYRGNSTGTLMVFFGNVDSSGIKHNIFNPPIIARYIRLHPTHYSIRS
TLRMELMGCDLNSCSMPLGMESKAISDAQITASSYFTNMFATWSPSKARLHLQGRSNAWRPQVNNPKEWLQV
DKQKTMKVTGVTTQGVKSLLTSMYVKEFLISSSQDGHQWTLFFQNGKVGVFQGNQDSFTPVVNSLDPPLLTR
YLRIHPQSWVHQIALRMEVLGCEAQDLY

TABLE 4

Nucleotide Sequence Encoding Full-Length FVIII (SEQ ID NO: 66)*

| 661 | | | | ATG CAAATAGAGC TCTCCACCTG |
|---|---|---|---|---|
| 721 | CTTCTTTCTG | TGCCTTTTGC | GATTCTGCTT | TAGTGCCACC AGAAGATACT ACCTGGGTGC |
| 781 | AGTGGAACTG | TCATGGGACT | ATATGCAAAG | TGATCTCGGT GAGCTGCCTG TGGACGCAAG |
| 841 | ATTTCCTCCT | AGAGTGCCAA | ATCTTTTCC | ATTCAACACC TCAGTCGTGT ACAAAAAGAC |
| 901 | TCTGTTTGTA | GAATTCACGG | ATCACCTTTT | CAACATCGCT AAGCCAAGGC CACCCTGGAT |
| 961 | GGGTCTGCTA | GGTCCTACCA | TCCAGGCTGA | GGTTTATGAT ACAGTGGTCA TTACACTTAA |
| 1021 | GAACATGGCT | TCCCATCCTG | TCAGTCTTCA | TGCTGTTGGT GTATCCTACT GGAAAGCTTC |
| 1081 | TGAGGGAGCT | GAATATGATG | ATCAGACCAG | TCAAAGGGAG AAAGAAGATG ATAAAGTCTT |
| 1141 | CCCTGGTGGA | AGCCATACAT | ATGTCTGGCA | GGTCCTGAAA GAGAATGGTC CAATGGCCTC |
| 1201 | TGACCCACTG | TGCCTTACCT | ACTCATATCT | TTCTCATGTG GACCTGGTAA AAGACTTGAA |
| 1261 | TTCAGGCCTC | ATTGGAGCCC | TACTAGTATG | TAGAGAAGGG AGTCTGGCCA AGGAAAAGAC |
| 1321 | ACAGACCTTG | CACAAATTTA | TACTACTTTT | TGCTGTATTT GATGAAGGGA AAAGTTGGCA |
| 1381 | CTCAGAAACA | AAGAACTCCT | TGATGCAGGA | TAGGGATGCT GCATCTGCTC GGGCCTGGCC |
| 1441 | TAAAATGCAC | ACAGTCAATG | GTTATGTAAA | CAGGTCTCTG CCAGGTCTGA TTGGATGCCA |
| 1501 | CAGGAAATCA | GTCTATTGGC | ATGTGATTGG | AATGGGCACC ACTCCTGAAG TGCACTCAAT |

TABLE 4-continued

Nucleotide Sequence Encoding Full-Length FVIII (SEQ ID NO: 66)*

```
1561 ATTCCTCGAA GGTCACACAT TCTTGTGAG GAACCATCGC CAGGCGTCCT TGGAAATCTC
1621 GCCAATAACT TTCCTTACTG CTCAAACACT CTTGATGGAC CTTGGACAGT TTCTACTGTT
1681 TTGTCATATC TCTTCCCACC AACATGATGG CATGGAAGCT TATGTCAAAG TAGACAGCTG
1741 TCCAGAGGAA CCCCAACTAC GAATGAAAAA TAATGAAGAA GCGGAAGACT ATGATGATGA
1801 TCTTACTGAT TCTGAAATGG ATGTGGTCAG GTTTGATGAT GACAACTCTC CTTCCTTTAT
1861 CCAAATTCGC TCAGTTGCCA AGAAGCATCC TAAAACTTGG GTACATTACA TTGCTGCTGA
1921 AGAGGAGGAC TGGGACTATG CTCCCTTAGT CCTCGCCCCC GATGACAGAA GTTATAAAAG
1981 TCAATATTTG AACAATGGCC CTCAGCGGAT TGGTAGGAAG TACAAAAAAG TCCGATTTAT
2041 GGCATACACA GATGAAACCT TTAAGACTCG TGAAGCTATT CAGCATGAAT CAGGAATCTT
2101 GGGACCTTTA CTTTATGGGG AAGTTGGAGA CACACTGTTG ATTATATTTA AGAATCAAGC
2161 AAGCAGACCA TATAACATCT ACCCTCACGG AATCACTGAT GTCCGTCCTT TGTATTCAAG
2221 GAGATTACCA AAAGGTGTAA ACATTTGAA GGATTTTCCA ATTCTGCCAG GAGAAATATT
2281 CAAATATAAA TGGACAGTGA CTGTAGAAGA TGGGCCAACT AAATCAGATC CTCGGTGCCT
2341 GACCCGCTAT TACTCTAGTT TCGTTAATAT GGAGAGAGAT CTAGCTTCAG GACTCATTGG
2401 CCCTCTCCTC ATCTGCTACA AAGAATCTGT AGATCAAAGA GGAAACCAGA TAATGTCAGA
2461 CAAGAGGAAT GTCATCCTGT TTTCTGTATT TGATGAGAAC CGAAGCTGGT ACCTCACAGA
2521 GAATATACAA CGCTTTCTCC CCAATCCAGC TGGAGTGCAG CTTGAGGATC CAGAGTTCCA
2581 AGCCTCCAAC ATCATGCACA GCATCAATGG CTATGTTTTT GATAGTTTGC AGTTGTCAGT
2641 TTGTTTGCAT GAGGTGGCAT ACTGGTACAT TCTAAGCATT GGAGCACAGA CTGACTTCCT
2701 TTCTGTCTTC TTCTCTGGAT ATACCTTCAA ACACAAAATG GTCTATGAAG ACACACTCAC
2761 CCTATTCCCA TTCTCAGGAG AAACTGTCTT CATGTCGATG GAAAACCCAG GTCTATGGAT
2821 TCTGGGGTGC CACAACTCAG ACTTTCGGAA CAGAGGCATG ACCGCCTTAC TGAAGGTTTC
2881 TAGTTGTGAC AAGAACACTG GTGATTATTA CGAGGACAGT TATGAAGATA TTTCAGCATA
2941 CTTGCTGAGT AAAAACAATG CCATTGAACC AAGAAGCTTC TCCCAGAATT CAAGACACCC
3001 TAGCACTAGG CAAAAGCAAT TTAATGCCAC CACAATTCCA GAAAATGACA TAGAGAAGAC
3061 TGACCCTTGG TTTGCACACA GAACACCTAT GCCTAAAATA CAAAATGTCT CCTCTAGTGA
3121 TTTGTTGATG CTCTTGCGAC AGAGTCCTAC TCCACATGGG CTATCCTTAT CTGATCTCCA
3181 AGAAGCCAAA TATGAGACTT TTTCTGATGA TCCATCACCT GGAGCAATAG ACAGTAATAA
3241 CAGCCTGTCT GAAATGACAC ACTTCAGGCC ACAGCTCCAT CACAGTGGGG ACATGGTATT
3301 TACCCCTGAG TCAGGCCTCC AATTAAGATT AAATGAGAAA CTGGGGACAA CTGCAGCAAC
3361 AGAGTTGAAG AAACTTGATT TCAAAGTTTC TAGTACATCA AATAATCTGA TTTCAACAAT
3421 TCCATCAGAC AATTTGGCAG CAGGTACTGA TAATACAAGT TCCTTAGGAC CCCCAAGTAT
3481 GCCAGTTCAT TATGATAGTC AATTAGATAC CACTCTATTT GGCAAAAAGT CATCTCCCCT
3541 TACTGAGTCT GGTGGACCTC TGAGCTTGAG TGAAGAAAAT AATGATTCAA AGTTGTTAGA
3601 ATCAGGTTTA ATGAATAGCC AAGAAAGTTC ATGGGGAAAA AATGTATCGT CAACAGAGAG
3661 TGGTAGGTTA TTTAAAGGGA AAAGAGCTCA TGGACCTGCT TGTTGACTA AAGATAATGC
3721 CTTATTCAAA GTTAGCATCT CTTTGTTAAA GACAAACAAA ACTTCCAATA ATTCAGCAAC
3781 TAATAGAAAG ACTCACATTG ATGGCCCATC ATTATTAATT GAGAATAGTC CATCAGTCTG
3841 GCAAAATATA TTAGAAAGTG ACACTGAGTT TAAAAAAGTG ACACCTTTGA TTCATGACAG
```

TABLE 4-continued

Nucleotide Sequence Encoding Full-Length FVIII (SEQ ID NO: 66)*

```
3901 AATGCTTATG GACAAAAATG CTACAGCTTT GAGGCTAAAT CATATGTCAA ATAAAACTAC
3961 TTCATCAAAA AACATGGAAA TGGTCCAACA GAAAAAGAG GGCCCCATTC CACCAGATGC
4021 ACAAAATCCA GATATGTCGT TCTTTAAGAT GCTATTCTTG CCAGAATCAG CAAGGTGGAT
4081 ACAAAGGACT CATGGAAAGA ACTCTCTGAA CTCTGGGCAA GGCCCAGTC CAAAGCAATT
4141 AGTATCCTTA GGACCAGAAA ATCTGTGGA AGGTCAGAAT TCTTGTCTG AGAAAAACAA
4201 AGTGGTAGTA GGAAAGGGTG AATTTACAAA GGACGTAGGA CTCAAAGAGA TGGTTTTTCC
4261 AAGCAGCAGA AACCTATTTC TTACTAACTT GGATAATTTA CATGAAAATA ATACACACAA
4321 TCAAGAAAAA AAAATTCAGG AAGAAATAGA AAGAAGGAA ACATTAATCC AAGAGAATGT
4381 AGTTTTGCCT CAGATACATA CAGTGACTGG CACTAAGAAT TCATGAAGA ACCTTTTCTT
4441 ACTGAGCACT AGGCAAAATG TAGAAGGTTC ATATGACGGG GCATATGCTC CAGTACTTCA
4501 AGATTTTAGG TCATTAAATG ATTCAACAAA TAGAACAAAG AAACACACAG CTCATTTCTC
4561 AAAAAAAGGG GAGGAAGAAA ACTTGGAAGG CTTGGGAAAT CAAACCAAGC AAATTGTAGA
4621 GAAATATGCA TGCACCACAA GGATATCTCC TAATACAAGC CAGCAGAATT TTGTCACGCA
4681 ACGTAGTAAG AGAGCTTTGA ACAATTCAG ACTCCCACTA GAAGAAACAG AACTTGAAAA
4741 AAGGATAATT GTGGATGACA CCTCAACCCA GTGGTCCAAA AACATGAAAC ATTTGACCCC
4801 GAGCACCCTC ACACAGATAG ACTACAATGA GAAGGAGAAA GGGGCCATTA CTCAGTCTCC
4861 CTTATCAGAT TGCCTTACGA GGAGTCATAG CATCCCTCAA GCAAATAGAT CTCCATTACC
4921 CATTGCAAAG GTATCATCAT TTCCATCTAT TAGACCTATA TATCTGACCA GGGTCCTATT
4981 CCAAGACAAC TCTTCTCATC TTCCAGCAGC ATCTTATAGA AGAAAGATT CTGGGGTCCA
5041 AGAAAGCAGT CATTTCTTAC AAGGAGCCAA AAAAATAAC CTTTCTTTAG CCATTCTAAC
5101 CTTGGAGATG ACTGGTGATC AAAGAGAGGT TGGCTCCCTG GGGACAAGTG CCACAAATTC
5161 AGTCACATAC AAGAAAGTTG AGAACACTGT TCTCCCGAAA CCAGACTTGC CAAAACATC
5221 TGGCAAAGTT GAATTGCTTC CAAAAGTTCA CATTTATCAG AAGGACCTAT TCCCTACGGA
5281 AACTAGCAAT GGGTCTCCTG GCCATCTGGA TCTCGTGGAA GGGAGCCTTC TTCAGGGAAC
5341 AGAGGGAGCG ATTAAGTGGA ATGAAGCAAA CAGACCTGGA AAAGTTCCCT TTCTGAGAGT
5401 AGCAACAGAA AGCTCTGCAA AGACTCCCTC CAAGCTATTG GATCCTCTTG CTTGGGATAA
5461 CCACTATGGT ACTCAGATAC CAAAAGAAGA GTGGAAATCC CAAGAGAAGT CACCAGAAAA
5521 AACAGCTTTT AAGAAAAAGG ATACCATTTT GTCCCTGAAC GCTTGTGAAA GCAATCATGC
5581 AATAGCAGCA ATAAATGAGG GACAAAATAA GCCCGAAATA GAAGTCACCT GGGCAAAGCA
5641 AGGTAGGACT GAAAGGCTGT GCTCTCAAAA CCCACCAGTC TTGAAACGCC ATCAACGGGA
5701 AATAACTCGT ACTACTCTTC AGTCAGATCA AGAGGAAATT GACTATGATG ATACCATATC
5761 AGTTGAAATG AAGAAGGAAG ATTTTGACAT TTATGATGAG GATGAAAATC AGAGCCCCCG
5821 CAGCTTTCAA AAGAAAACAC GACACTATTT TATTGCTGCA GTGGAGAGGC TCTGGGATTA
5881 TGGGATGAGT AGCTCCCCAC ATGTTCTAAG AAACAGGGCT CAGAGTGGCA GTGTCCCTCA
5941 GTTCAAGAAA GTTGTTTTCC AGGAATTTAC TGATGGCTCC TTTACTCAGC CCTTATACCG
6001 TGGAGAACTA AATGAACATT TGGGACTCCT GGGGCCATAT ATAAGAGCAG AAGTTGAAGA
6061 TAATATCATG GTAACTTTCA GAAATCAGGC CTCTCGTCCC TATTCCTTCT ATTCTAGCCT
6121 TATTTCTTAT GAGGAAGATC AGAGGCAAGG AGCAGAACCT AGAAAAAACT TTGTCAAGCC
6181 TAATGAAACC AAAACTTACT TTTGGAAAGT GCAACATCAT ATGGCACCCA CTAAAGATGA
```

TABLE 4-continued

Nucleotide Sequence Encoding Full-Length FVIII (SEQ ID NO: 66)*

```
6241 GTTTGACTGC AAAGCCTGGG CTTATTTCTC TGATGTTGAC CTGGAAAAAG ATGTGCACTC

6301 AGGCCTGATT GGACCCCTTC TGGTCTGCCA CACTAACACA CTGAACCCTG CTCATGGGAG

6361 ACAAGTGACA GTACAGGAAT TTGCTCTGTT TTTCACCATC TTTGATGAGA CCAAAAGCTG

6421 GTACTTCACT GAAAATATGG AAAGAAACTG CAGGGCTCCC TGCAATATCC AGATGGAAGA

6481 TCCCACTTTT AAAGAGAATT ATCGCTTCCA TGCAATCAAT GGCTACATAA TGGATACACT

6541 ACCTGGCTTA GTAATGGCTC AGGATCAAAG GATTCGATGG TATCTGCTCA GCATGGGCAG

6601 CAATGAAAAC ATCCATTCTA TTCATTTCAG TGGACATGTG TTCACTGTAC GAAAAAAGA

6661 GGAGTATAAA ATGGCACTGT ACAATCTCTA TCCAGGTGTT TTTGAGACAG TGGAAATGTT

6721 ACCATCCAAA GCTGGAATTT GGCGGGTGGA ATGCCTTATT GGCGAGCATC TACATGCTGG

6781 GATGAGCACA CTTTTTCTGG TGTACAGCAA TAAGTGTCAG ACTCCCCTGG GAATGGCTTC

6841 TGGACACATT AGAGATTTTC AGATTACAGC TTCAGGACAA TATGGACAGT GGGCCCCAAA

6901 GCTGGCCAGA CTTCATTATT CCGGATCAAT CAATGCCTGG AGCACCAAGG AGCCCTTTTC

6961 TTGGATCAAG GTGGATCTGT TGGCACCAAT GATTATTCAC GGCATCAAGA CCCAGGGTGC

7021 CCGTCAGAAG TTCTCCAGCC TCTACATCTC TCAGTTTATC ATCATGTATA GTCTTGATGG

7081 GAAGAAGTGG CAGACTTATC GAGGAAATTC CACTGGAACC TTAATGGTCT TCTTTGGCAA

7141 TGTGGATTCA TCTGGGATAA AACACAATAT TTTTAACCCT CCAATTATTG CTCGATACAT

7201 CCGTTTGCAC CCAACTCATT ATAGCATTCG CAGCACTCTT CGCATGGAGT TGATGGGCTG

7261 TGATTTAAAT AGTTGCAGCA TGCCATTGGG AATGGAGAGT AAAGCAATAT CAGATGCACA

7321 GATTACTGCT TCATCCTACT TTACCAATAT GTTTGCCACC TGGTCTCCTT CAAAAGCTCG

7381 ACTTCACCTC CAAGGGAGGA GTAATGCCTG GAGACCTCAG GTGAATAATC CAAAAGAGTG

7441 GCTGCAAGTG GACTTCCAGA AGACAATGAA AGTCACAGGA GTAACTACTC AGGGAGTAAA

7501 ATCTCTGCTT ACCAGCATGT ATGTGAAGGA GTTCCTCATC TCCAGCAGTC AAGATGGCCA

7561 TCAGTGGACT CTCTTTTTTC AGAATGGCAA AGTAAAGGTT TTTCAGGGAA ATCAAGACTC

7621 CTTCACACCT GTGGTGAACT CTCTAGACCC ACCGTTACTG ACTCGCTACC TTCGAATTCA

7681 CCCCCAGAGT TGGGTGCACC AGATTGCCCT GAGGATGGAG GTTCTGGGCT GCGAGGCACA

7741 GGACCTCTAC
```

*The underlined nucleic acids encode a signal peptide.

FVIII polypeptides include full-length FVIII, full-length FVIII minus Met at the N-terminus, mature FVIII (minus the signal sequence), mature FVIII with an additional Met at the N-terminus, and/or FVIII with a full or partial deletion of the B domain. In certain embodiments, FVIII variants include B domain deletions, whether partial or full deletions.

The sequence of native mature human FVIII is presented as SEQ ID NO: 65. A native FVIII protein has the following formula: A1-a1-A2-a2-B-a3-A3-C1-C2, where A1, A2, and A3 are the structurally-related "A domains," B is the "B domain," C1 and C2 are the structurally-related "C domains," and a1, a2 and a3 are acidic spacer regions. Referring to the primary amino acid sequence position in SEQ ID NO:65, the A1 domain of human FVIII extends from Ala1 to about Arg336, the a1 spacer region extends from about Met337 to about Val374, the A2 domain extends from about Ala375 to about Tyr719, the a2 spacer region extends from about Glu720 to about Arg740, the B domain extends from about Ser741 to about Arg 1648, the a3 spacer region extends from about Glu1649 to about Arg1689, the A3 domain extends from about Ser1690 to about Leu2025, the C1 domain extends from about Gly2026 to about Asn2072, and the C2 domain extends from about Ser2073 to Tyr2332. Other than specific proteolytic cleavage sites, designation of the locations of the boundaries between the domains and regions of FVIII can vary in different literature references. The boundaries noted herein are therefore designated as approximate by use of the term "about."

The human FVIII gene was isolated and expressed in mammalian cells (Toole, J. J., et al., Nature 312:342-347 (1984); Gitschier, J., et al., Nature 312:326-330 (1984); Wood, W. I., et al., Nature 312:330-337 (1984); Vehar, G. A., et al., Nature 312:337-342 (1984); WO 87/04187; WO 88/08035; WO 88/03558; and U.S. Pat. No. 4,757,006). The FVIII amino acid sequence was deduced from cDNA as shown in U.S. Pat. No. 4,965,199. In addition, partially or fully B-domain deleted FVIII is shown in U.S. Pat. Nos. 4,994,371 and 4,868,112. In some embodiments, the human FVIII B-domain is replaced with the human Factor V B-domain as shown in U.S. Pat. No. 5,004,803. The cDNA sequence encoding human Factor VIII and amino acid sequence are shown in SEQ ID NOs: 1 and 2, respectively, of US Application Publ. No. 2005/0100990.

The porcine FVIII sequence is published in Toole, J. J., et al., *Proc. Natl. Acad. Sci. USA* 83:5939-5942 (1986). Further, the complete porcine cDNA sequence obtained from PCR amplification of FVIII sequences from a pig spleen cDNA library has been reported in Healey, J. F., et al., *Blood* 88:4209-4214 (1996). Hybrid human/porcine FVIII having substitutions of all domains, all subunits, and specific amino acid sequences were disclosed in U.S. Pat. No. 5,364,771 by Lollar and Runge, and in WO 93/20093. More recently, the nucleotide and corresponding amino acid sequences of the A1 and A2 domains of porcine FVIII and a chimeric FVIII with porcine A1 and/or A2 domains substituted for the corresponding human domains were reported in WO 94/11503. U.S. Pat. No. 5,859,204, Lollar, J. S., also discloses the porcine cDNA and deduced amino acid sequences. U.S. Pat. No. 6,458,563 discloses a B-domain-deleted porcine FVIII.

U.S. Pat. No. 5,859,204 to Lollar, J. S. reports functional mutants of FVIII having reduced antigenicity and reduced immunoreactivity. U.S. Pat. No. 6,376,463 to Lollar, J. S. also reports mutants of FVIII having reduced immunoreactivity. US Appl. Publ. No. 2005/0100990 to Saenko et al. reports functional mutations in the A2 domain of FVIII.

In one embodiment, the FVIII (or FVIII portion of a chimeric protein) may be at least 50%, 60%, 70%, 80%, 90%, 95%, 96%, 97%, 98%, 99%, or 100% identical to a FVIII amino acid sequence of amino acids 1 to 1438 of SEQ ID NO: 67 or amino acids 1 to 2332 of SEQ ID NO: 65 (without a signal sequence) or a FVIII amino acid sequence of amino acids 1 to 19 of SEQ ID NO: 64 and 1 to 1438 of SEQ ID NO: 67 or amino acids 1 to 19 of SEQ ID NO: 64 and amino acids 1 to 2332 of SEQ ID NO: 65 (with a signal sequence), wherein the FVIII has a clotting activity, e.g., activates Factor IX as a cofactor to convert Factor X to activated Factor X. The FVIII (or FVIII portion of a chimeric protein) may be identical to a FVIII amino acid sequence of amino acids 1 to 1438 of SEQ ID NO: 67 or amino acids 1 to 2332 of SEQ ID NO: 65 (without a signal sequence). The FVIII may further comprise a signal sequence.

The "B-domain" of FVIII, as used herein, is the same as the B-domain known in the art that is defined by internal amino acid sequence identity and sites of proteolytic cleavage, e.g., residues Ser741-Arg1648 of full-length human FVIII. The other human FVIII domains are defined by the following amino acid residues: A1, residues Ala1-Arg372; A2, residues Ser373-Arg740; A3, residues Ser1690-Asn2019; C1, residues Lys2020-Asn2172; C2, residues Ser2173-Tyr2332. The A3-C1-C2 sequence includes residues Ser1690-Tyr2332. The remaining sequence, residues Glu1649-Arg1689, is usually referred to as the a3 acidic region. The locations of the boundaries for all of the domains, including the B-domains, for porcine, mouse and canine FVIII are also known in the art. In one embodiment, the B domain of FVIII is deleted ("B-domain-deleted factor VIII" or "BDD FVIII"). An example of a BDD FVIII is REFACTO® (recombinant BDD FVIII), which has the same sequence as the Factor VIII portion of the sequence in Table 5. (BDD FVIII heavy chain is double underlined; B domain is italicized; and BDD FVIII light chain is in plain text). A nucleotide sequence encoding Table 6 (SEQ ID NO: 68) is shown in Table 6.

TABLE 5

Amino Acid Sequence of B-domain Deleted Factor VIII (BBD FVIII)

BDD FVIII (SEQ ID NO: 67)
ATRRYYLGAVELSWDYMQSDLGELPVDARFPPRVPKSFPFNTSVVYKKTLFVEFTDHLFNIAKPRPPWMGLL

GPTIQAEVYDTVVITLKNMASHPVSLHAVGVSYWKASEGAEYDDQTSQREKEDDKVFPGGSHTYVWQVLKEN

GPMASDPLCLTYSYLSHVDLVKDLNSGLIGALLVCREGSLAKEKTQTLHKFILLFAVFDEGKSWHSETKNSL

MQDRDAASARAWPKMHTVNGYVNRSLPGLIGCHRKSVYWHVIGMGTTPEVHSIFLEGHTFLVRNHRQASLEI

SPITFLTAQTLLMDLGQFLLFCHISSHQHDGMEAYVKVDSCPEEPQLRMKNNEEAEDYDDDLTDSEMDVVRF

DDDNSPSFIQIRSVAKKHPKTWVHYIAAEEEDWDYAPLVLAPDDRSYKSQYLNNGPQRIGRKYKKVRFMAYT

DETFKTREAIQHESGILGPLLYGEVGDTLLIIFKNQASRPYNIYPHGITDVRPLYSRRLPKGVKHLKDFPIL

PGEIFKYKWTVTVEDGPTKSDPRCLTRYYSSFVNMERDLASGLIGPLLICYKESVDQRGNQIMSDKRNVILF

WVFDENRSWYLTENIQRFLPNPAGVQLEDPEFQASNIMHSINGYVFDSLQLSVCLHEVAYWYILSIGAQTDF

LSVFFSGYTFKHKMVYEDTLTLFPFSGETVFMSMENPGLWILGCHNSDFRNRGMTALLKVSSCDKNTGDYYE

DSYEDISAYLLSKNNAIEPR*SFSQNPPVLKRHQR*EITRTTLQSDQEEIDYDDTISVEMKKEDFDIYDEDENQ

SPRSFQKKTRHYFIAAVERLWDYGMSSSPHVLRNRAQSGSVPQFKKVVFQEFTDGSFTQPLYRGELNEHLGL

LGPYIRAEVEDNIMVTFRNQASRPYSFYSSLISYEEDQRQGAEPRKNFVKPNETKTYFWKVQHHMAPTKDEF

DCKAWAYFSDVDLEKDVHSGLIGPLLVCHTNTLNPAHGRQVTVQEFALFFTIFDETKSWYFTENMERNCRAP

CNIQMEDPTFKENYRFHAINGYIMDTLPGLVMAQDQRIRWYLLSMGSNENIHSIHFSGHVFTVRKKEEYKMA

LYNLYPGVFETVEMLPSKAGIWRVECLIGEHLHAGMSTLFLVYSKNCQTPLGMASGHIRDFQITASGQYGQW

TABLE 5-continued

Amino Acid Sequence of B-domain
Deleted Factor VIII (BBD FVIII)

APKLARLHYSGSINAWSTKEPFSWIKVDLLAPMIIHGIKTQGARQKFSSLYISQFIIMYSLDGKKWQTYRGN
STGTLMVFFGNVDSSGIKHNIFNPPIIARYIRLHPTHYSIRSTLRMELMGCDLNSCSMPLGMESKAISDAQI
TASSYFTNMFATWSPSKARLHLQGRSNAWRPQVNNPKEWLQVDFQKTMKVTGVTTQGVKSLLTSMYVKEFLI
SSSQDGHQWTLFFQNGKVKVFQGNQDSFTPVVNSLDPPLLTRYLRIHPQSWVHQIALRMEVLGCEAQDLY

TABLE 6

| Nucleotide Sequence Encoding BDD FVIII (SEQ ID NO: 68)* |
| --- |
| 661        A TGCAAATAGA GCTCTCCACC TGCTTCTTTC |
| 721 TGTGCCTTTT GCGATTCTGC TTTAGTGCCA CCAGAAGATA CTACCTGGGT GCAGTGGAAC |
| 781 TGTCATGGGA CTATATGCAA AGTGATCTCG GTGAGCTGCC TGTGGACGCA AGATTTCCTC |
| 841 CTAGAGTGCC AAAATCTTTT CCATTCAACA CCTCAGTCGT GTACAAAAAG ACTCTGTTTG |
| 901 TAGAATTCAC GGATCACCTT TTCAACATCG CTAAGCCAAG GCCACCCTGG ATGGGTCTGC |
| 961 TAGGTCCTAC CATCCAGGCT GAGGTTTATG ATACAGTGGT CATTACACTT AAGAACATGG |
| 1021 CTTCCCATCC TGTCAGTCTT CATGCTGTTG GTGTATCCTA CTGGAAAGCT TCTGAGGGAG |
| 1081 CTGAATATGA TGATCAGACC AGTCAAAGGG AGAAAGAAGA TGATAAAGTC TTCCCTGGTG |
| 1141 GAAGCCATAC ATATGTCTGG CAGGTCCTGA AAGAGAATGG TCCAATGGCC TCTGACCCAC |
| 1201 TGTGCCTTAC CTACTCATAT CTTTCTCATG TGGACCTGGT AAAAGACTTG AATTCAGGCC |
| 1261 TCATTGGAGC CCTACTAGTA TGTAGAGAAG GGAGTCTGGC CAAGGAAAAG ACACAGACCT |
| 1321 TGCACAAATT TATACTACTT TTTGCTGTAT TTGATGAAGG GAAAAGTTGG CACTCAGAAA |
| 1381 CAAAGAACTC CTTGATGCAG GATAGGGATG CTGCATCTGC TCGGGCCTGG CCTAAAATGC |
| 1441 ACACAGTCAA TGGTTATGTA AACAGGTCTC TGCCAGGTCT GATTGGATGC CACAGGAAAT |
| 1501 CAGTCTATTG GCATGTGATT GGAATGGGCA CCACTCCTGA AGTGCACTCA ATATTCCTCG |
| 1561 AAGGTCACAC ATTTCTTGTG AGGAACCATC GCCAGGCGTC CTTGGAAATC TCGCCAATAA |
| 1621 CTTTCCTTAC TGCTCAAACA CTCTTGATGG ACCTTGGACA GTTTCTACTG TTTTGTCATA |
| 1681 TCTCTTCCCA CCAACATGAT GGCATGGAAG CTTATGTCAA AGTAGACAGC TGTCCAGAGG |
| 1741 AACCCCAACT ACGAATGAAA AATAATGAAG AAGCGGAAGA CTATGATGAT GATCTTACTG |
| 1801 ATTCTGAAAT GGATGTGGTC AGGTTTGATG ATGACAACTC TCCTTCCTTT ATCCAAATTC |
| 1861 GCTCAGTTGC CAAGAAGCAT CCTAAAACTT GGGTACATTA CATTGCTGCT GAAGAGGAGG |
| 1921 ACTGGGACTA TGCTCCCTTA GTCCTCGCCC CCGATGACAG AAGTTATAAA AGTCAATATT |
| 1981 TGAACAATGG CCCTCAGCGG ATTGGTAGGA AGTACAAAAA AGTCCGATTT ATGGCATACA |
| 2041 CAGATGAAAC CTTTAAGACT CGTGAAGCTA TTCAGCATGA ATCAGGAATC TTGGGACCTT |
| 2101 TACTTTATGG GGAAGTTGGA GACACACTGT TGATTATATT TAAGAATCAA GCAAGCAGAC |
| 2161 CATATAACAT CTACCCTCAC GGAATCACTG ATGTCCGTCC TTTGTATTCA AGGAGATTAC |
| 2221 CAAAAGGTGT AAAACATTTG AAGGATTTTC CAATTCTGCC AGGAGAAATA TTCAAATATA |
| 2281 AATGGACAGT GACTGTAGAA GATGGGCCAA CTAAATCAGA TCCTCGGTGC CTGACCCGCT |
| 2341 ATTACTCTAG TTTCGTTAAT ATGGAGAGAG ATCTAGCTTC AGGACTCATT GGCCCTCTCC |
| 2401 TCATCTGCTA CAAAGAATCT GTAGATCAAA GAGGAAACCA GATAATGTCA GACAAGAGGA |
| 2461 ATGTCATCCT GTTTTCTGTA TTTGATGAGA ACCGAAGCTG GTACCTCACA GAGAATATAC |

TABLE 6-continued

Nucleotide Sequence Encoding BDD FVIII (SEQ ID NO: 68)*

| | | | | | |
|---|---|---|---|---|---|
| 2521 | AACGCTTTCT | CCCCAATCCA | GCTGGAGTGC | AGCTTGAGGA | TCCAGAGTTC | CAAGCCTCCA |
| 2581 | ACATCATGCA | CAGCATCAAT | GGCTATGTTT | TTGATAGTTT | GCAGTTGTCA | GTTTGTTTGC |
| 2641 | ATGAGGTGGC | ATACTGGTAC | ATTCTAAGCA | TTGGAGCACA | GACTGACTTC | CTTTCTGTCT |
| 2701 | TCTTCTCTGG | ATATACCTTC | AAACACAAAA | TGGTCTATGA | AGACACACTC | ACCCTATTCC |
| 2761 | CATTCTCAGG | AGAAACTGTC | TTCATGTCGA | TGGAAACCCA | GGTCTATGG | ATTCTGGGGT |
| 2821 | GCCACAACTC | AGACTTTCGG | AACAGAGGCA | TGACCGCCTT | ACTGAAGGTT | CTAGTTGTG |
| 2881 | ACAAGAACAC | TGGTGATTAT | TACGAGGACA | GTTATGAAGA | TATTTCAGCA | TACTTGCTGA |
| 2941 | GTAAAAACAA | TGCCATTGAA | CCAAGAAGCT | TCTCTCAAAA | CCCACCAGTC | TTGAAACGCC |
| 3001 | ATCAACGGGA | ATAACTCGT | ACTACTCTTC | AGTCAGATCA | AGAGGAAATT | GACTATGATG |
| 3061 | ATACCATATC | AGTTGAAATG | AAGAAGGAAG | ATTTTGACAT | TTATGATGAG | GATGAAAATC |
| 3121 | AGAGCCCCCG | CAGCTTTCAA | AAGAAAACAC | GACACTATTT | TATTGCTGCA | GTGGAGAGGC |
| 3181 | TCTGGGATTA | TGGGATGAGT | AGCTCCCCAC | ATGTTCTAAG | AAACAGGGCT | CAGAGTGGCA |
| 3241 | GTGTCCCTCA | GTTCAAGAAA | GTTGTTTTCC | AGGAATTTAC | TGATGGCTCC | TTTACTCAGC |
| 3301 | CCTTATACCG | TGGAGAACTA | AATGAACATT | TGGGACTCCT | GGGGCCATAT | ATAAGAGCAG |
| 3361 | AAGTTGAAGA | TAATATCATG | GTAACTTTCA | GAAATCAGGC | CTCTCGTCCC | TATTCCTTCT |
| 3421 | ATTCTAGCCT | TATTTCTTAT | GAGGAAGATC | AGAGGCAAGG | AGCAGAACCT | AGAAAAACT |
| 3481 | TTGTCAAGCC | TAATGAAACC | AAAACTTACT | TTTGGAAAGT | GCAACATCAT | ATGGCACCCA |
| 3541 | CTAAAGATGA | GTTTGACTGC | AAAGCCTGGG | CTTATTTCTC | TGATGTTGAC | CTGGAAAAAG |
| 3601 | ATGTGCACTC | AGGCCTGATT | GGACCCCTTC | TGGTCTGCCA | CACTAACACA | CTGAACCCTG |
| 3661 | CTCATGGGAG | ACAAGTGACA | GTACAGGAAT | TTGCTCTGTT | TTTCACCATC | TTTGATGAGA |
| 3721 | CCAAAAGCTG | GTACTTCACT | GAAAATATGG | AAAGAAACTG | CAGGGCTCCC | TGCAATATCC |
| 3781 | AGATGGAAGA | TCCCACTTTT | AAAGAGAATT | ATCGCTTCCA | TGCAATCAAT | GGCTACATAA |
| 3841 | TGGATACACT | ACCTGGCTTA | GTAATGGCTC | AGGATCAAAG | GATTCGATGG | TATCTGCTCA |
| 3901 | GCATGGGCAG | CAATGAAAAC | ATCCATTCTA | TTCATTTCAG | TGGACATGTG | TTCACTGTAC |
| 3961 | GAAAAAAAGA | GGAGTATAAA | ATGGCACTGT | ACAATCTCTA | TCCAGGTGTT | TTTGAGACAG |
| 4021 | TGGAAATGTT | ACCATCCAAA | GCTGGAATTT | GGCGGGTGGA | ATGCCTTATT | GGCGAGCATC |
| 4081 | TACATGCTGG | GATGAGCACA | CTTTTTCTGG | TGTACAGCAA | TAAGTGTCAG | ACTCCCCTGG |
| 4141 | GAATGGCTTC | TGGACACATT | AGAGATTTTC | AGATTACAGC | TTCAGGACAA | TATGGACAGT |
| 4201 | GGGCCCCAAA | GCTGGCCAGA | CTTCATTATT | CCGGATCAAT | CAATGCCTGG | AGCACCAAGG |
| 4261 | AGCCCTTTTC | TTGGATCAAG | GTGGATCTGT | TGGCACCAAT | GATTATTCAC | GGCATCAAGA |
| 4321 | CCCAGGGTGC | CCGTCAGAAG | TTCTCCAGCC | TCTACATCTC | TCAGTTTATC | ATCATGTATA |
| 4381 | GTCTTGATGG | GAAGAAGTGG | CAGACTTATC | GAGGAAATTC | CACTGGAACC | TTAATGGTCT |
| 4441 | TCTTTGGCAA | TGTGGATTCA | TCTGGGATAA | ACACAATAT | TTTTAACCCT | CCAATTATTG |
| 4501 | CTCGATACAT | CCGTTTGCAC | CCAACTCATT | ATAGCATTCG | CAGCACTCTT | CGCATGGAGT |
| 4561 | TGATGGGCTG | TGATTTAAAT | AGTTGCAGCA | TGCCATTGGG | AATGGAGAGT | AAAGCAATAT |
| 4621 | CAGATGCACA | GATTACTGCT | TCATCCTACT | TTACCAATAT | GTTTGCCACC | TGGTCTCCTT |
| 4681 | CAAAAGCTCG | ACTTCACCTC | CAAGGGAGGA | GTAATGCCTG | GAGACCTCAG | GTGAATAATC |
| 4741 | CAAAAGAGTG | GCTGCAAGTG | GACTTCCAGA | AGACAATGAA | AGTCACAGGA | GTAACTACTC |
| 4801 | AGGGAGTAAA | ATCTCTGCTT | ACCAGCATGT | ATGTGAAGGA | GTTCCTCATC | TCCAGCAGTC |

TABLE 6-continued

Nucleotide Sequence Encoding BDD FVIII (SEQ ID NO: 68)*

```
4861 AAGATGGCCA TCAGTGGACT CTCTTTTTTC AGAATGGCAA AGTAAAGGTT TTTCAGGGAA
4921 ATCAAGACTC CTTCACACCT GTGGTGAACT CTCTAGACCC ACCGTTACTG ACTCGCTACC
4981 TTCGAATTCA CCCCCAGAGT TGGGTGCACC AGATTGCCCT GAGGATGGAG GTTCTGGGCT
5041 GCGAGGCACA GGACCTCTAC
```

*The underlined nucleic acids encode a signal peptide.

A "B-domain-deleted FVIII" may have the full or partial deletions disclosed in U.S. Pat. Nos. 6,316,226, 6,346,513, 7,041,635, 5,789,203, 6,060,447, 5,595,886, 6,228,620, 5,972,885, 6,048,720, 5,543,502, 5,610,278, 5,171,844, 5,112,950, 4,868,112, and 6,458,563. In some embodiments, a B-domain-deleted FVIII sequence of the present invention comprises any one of the deletions disclosed at col. 4, line 4 to col. 5, line 28 and Examples 1-5 of U.S. Pat. No. 6,316,226 (also in U.S. Pat. No. 6,346,513). In another embodiment, a B-domain deleted Factor VIII is the S743/Q1638 B-domain deleted Factor VIII (SQ BDD FVIII) (e.g., Factor VIII having a deletion from amino acid 744 to amino acid 1637, e.g., Factor VIII having amino acids 1-743 and amino acids 1638-2332 of SEQ ID NO: 65, i.e., SEQ ID NO: 67). In some embodiments, a B-domain-deleted FVIII of the present invention has a deletion disclosed at col. 2, lines 26-51 and examples 5-8 of U.S. Pat. No. 5,789,203 (also U.S. Pat. Nos. 6,060,447, 5,595,886, and 6,228,620). In some embodiments, a B-domain-deleted Factor VIII has a deletion described in col. 1, lines 25 to col. 2, line 40 of U.S. Pat. No. 5,972,885; col. 6, lines 1-22 and example 1 of U.S. Pat. No. 6,048,720; col. 2, lines 17-46 of U.S. Pat. No. 5,543,502; col. 4, line 22 to col. 5, line 36 of U.S. Pat. No. 5,171,844; col. 2, lines 55-68, FIG. 2, and example 1 of U.S. Pat. No. 5,112,950; col. 2, line 2 to col. 19, line 21 and table 2 of U.S. Pat. No. 4,868,112; col. 2, line 1 to col. 3, line 19, col. 3, line 40 to col. 4, line 67, col. 7, line 43 to col. 8, line 26, and col. 11, line 5 to col. 13, line 39 of U.S. Pat. No. 7,041,635; or col. 4, lines 25-53, of U.S. Pat. No. 6,458,563. In some embodiments, a B-domain-deleted FVIII has a deletion of most of the B domain, but still contains amino-terminal sequences of the B domain that are essential for in vivo proteolytic processing of the primary translation product into two polypeptide chain, as disclosed in WO 91/09122. In some embodiments, a B-domain-deleted FVIII is constructed with a deletion of amino acids 747-1638, i.e., virtually a complete deletion of the B domain. Hoeben R. C., et al. *J. Biol. Chem.* 265 (13): 7318-7323 (1990). A B-domain-deleted Factor VIII may also contain a deletion of amino acids 771-1666 or amino acids 868-1562 of FVIII. Meulien P., et al. *Protein Eng.* 2(4): 301-6 (1988). Additional B domain deletions that are part of the invention include: deletion of amino acids 982 through 1562 or 760 through 1639 (Toole et al., *Proc. Natl. Acad. Sci. U.S.A.* (1986) 83, 5939-5942)), 797 through 1562 (Eaton, et al. *Biochemistry* (1986) 25:8343-8347)), 741 through 1646 (Kaufman (PCT published application No. WO 87/04187)), 747-1560 (Sarver, et al., *DNA* (1987) 6:553-564)), 741 through 1648 (Pasek (PCT application No. 88/00831)), or 816 through 1598 or 741 through 1648 (Lagner (Behring Inst. Mitt. (1988) No 82:16-25, EP 295597)). In other embodiments, BDD FVIII includes a FVIII polypeptide containing fragments of the B-domain that retain one or more N-linked glycosylation sites, e.g., residues 757, 784, 828, 900, 963, or optionally 943, which correspond to the amino acid sequence of the full-length FVIII sequence. Examples of the B-domain fragments include 226 amino acids or 163 amino acids of the B-domain as disclosed in Miao, H. Z., et al., *Blood* 103(a): 3412-3419 (2004), Kasuda, A, et al., *J. Thromb. Haemost.* 6: 1352-1359 (2008), and Pipe, S. W., et al., *J. Thromb. Haemost.* 9: 2235-2242 (2011) (i.e., the first 226 amino acids or 163 amino acids of the B domain are retained). In still other embodiments, BDD FVIII further comprises a point mutation at residue 309 (from Phe to Ser) to improve expression of the BDD FVIII protein. See Miao, H. Z., et al., *Blood* 103(a): 3412-3419 (2004). In still other embodiments, the BDD FVIII includes a FVIII polypeptide containing a portion of the B-domain, but not containing one or more furin cleavage sites (e.g., Arg1313 and Arg 1648). See Pipe, S. W., et al., *J. Thromb. Haemost.* 9: 2235-2242 (2011). Each of the foregoing deletions may be made in any FVIII sequence.

In some embodiments, the FVIII has a partial B-domain. In some embodiments, the FVIII protein with a partial B-domain is FVIII198. FVIII198 is a partial B-domain containing single chain FVIIIFc molecule-226N6. Number 226 represents the N-terminus 226 amino acid of the FVIII B-domain, and N6 represents six N-glycosylation sites in the B-domain.

In one embodiment, FVIII is cleaved right after Arginine at amino acid 1648 (in full-length Factor VIII or SEQ ID NO: 65), amino acid 754 (in the S743/Q1638 B-domain deleted Factor VIII or SEQ ID NO: 67), or the corresponding Arginine residue (in other variants), thereby resulting in a heavy chain and a light chain. In another embodiment, FVIII comprises a heavy chain and a light chain, which are linked or associated by a metal ion-mediated non-covalent bond.

In other embodiments, FVIII is a single chain FVIII that has not been cleaved right after Arginine at amino acid 1648 (in full-length FVIII or SEQ ID NO: 65), amino acid 754 (in the S743/Q1638 B-domain-deleted FVIII or SEQ ID NO: 67), or the corresponding Arginine residue (in other variants). A single chain FVIII may comprise one or more amino acid substitutions. In one embodiment, the amino acid substitution is at a residue corresponding to residue 1648, residue 1645, or both of full-length mature Factor VIII polypeptide (SEQ ID NO: 65) or residue 754, residue 751, or both of SQ BDD Factor VIII (SEQ ID NO: 67). The amino acid substitution can be any amino acids other than Arginine, e.g., isoleucine, leucine, lysine, methionine, phenylalanine, threonine, tryptophan, valine, alanine, asparagine, aspartic acid, cysteine, glutamic acid, glutamine, glycine, proline, selenocysteine, serine, tyrosine, histidine, ornithine, pyrrolysine, or taurine.

FVIII can further be cleaved by thrombin and then activated as FVIIIa, serving as a cofactor for activated Factor IX (FIXa). And the activated FIX together with activated FVIII forms a Xase complex and converts Factor X to activated Factor X (FXa). For activation, FVIII is cleaved by thrombin after three Arginine residues, at amino acids 372, 740, and 1689 (corresponding to amino acids 372, 740, and 795 in the B-domain deleted FVIII sequence), the cleavage generating FVIIIa having the 50 kDa A1, 43 kDa A2, and 73 kDa A3-C1-C2 chains. In one embodiment, the FVIII protein useful for the present invention is non-active FVIII. In another embodiment, the FVIII protein is an activated FVIII.

The protein having FVIII polypeptide linked to or associated with the VWF protein can comprise a sequence at least 50%, 60%, 70%, 80%, 90%, 95%, 96%, 97%, 98%, 99%, or 100% identical to SEQ ID NO: 65 or 67, wherein the sequence has the FVIII clotting activity, e.g., activating Factor IX as a cofactor to convert Factor X to activated Factor X (FXa).

"Hybrid" or "chimeric" polypeptides and proteins, as used herein, includes a combination of a first polypeptide chain, e.g., the VWF protein fused to an XTEN sequence having less than 288 amino acids and a first Ig constant region or a portion thereof, with a second polypeptide chain, e.g., a FVIII protein fused to a second Ig constant region or a portion thereof, thereby forming a heterodimer. In one embodiment, the first polypeptide and the second polypeptide in a hybrid are associated with each other via protein-protein interactions, such as charge-charge or hydrophobic interactions. In another embodiment, a first polypeptide comprises a VWF protein-XTEN-Fc fusion protein, and a second polypeptide comprises FVIII-Fc fusion protein, making the hybrid a heterodimer, wherein the XTEN contains less than 288 amino acids. In other embodiments, the first polypeptide comprises a VWF protein-XTEN-Fc fusion protein, and the second polypeptide comprises FVIII(X)-Fc fusion protein, making the hybrid a heterodimer, wherein the XTEN contains less than 288 amino acids. The first polypeptide and the second polypeptide can be associated through a covalent bond, e.g., a disulfide bond, between the first Fc region and the second Fc region. The first polypeptide and the second polypeptide can further be associated with each other by binding between the VWF fragment and the FVIII protein.

A FVIII protein useful in the present invention can include FVIII having one or more additional XTEN sequences, which do not affect the FVIII coagulation activity. Such XTEN sequences can be fused to the C-terminus or N-terminus of the FVIII protein or inserted between one or more of the two amino acid residues in the FVIII protein while the insertions do not affect the FVIII coagulation activity or FVIII function. In one embodiment, the insertions improve pharmacokinetic properties of the FVIII protein (e.g., half-life). In another embodiment, the insertions can be multiple insertions, e.g., more than two, three, four, five, six, seven, eight, nine, or ten insertions. Examples of the insertion sites include, but are not limited to, the sites listed in Tables 7, 8, 9, 10, 11, 12, 13, 14, 15 or any combinations thereof.

The FVIII protein linked to one or more XTEN sequences can be represented as FVIII(X2) or FVIII$_{(a \to b)}$-X-FVIII$_{(c \to d)}$, wherein FVIII$_{(a \to b)}$ comprises, consists essentially of, or consists of a first portion of a FVIII protein from amino acid residue "a" to amino acid residue "b"; X2 comprises, consists essentially of, or consists of one or more XTEN sequences, FVIII$_{(c \to d)}$ comprises, consists essentially of, or consists of a second portion of a FVIII protein from amino acid residue "c" to amino acid residue "d";

a is the N-terminal amino acid residue of the first portion of the FVIII protein,
b is the C-terminal amino acid residue of the first portion of the FVIII protein but is also the N-terminal amino acid residue of the two amino acids of an insertion site in which the XTEN sequence is inserted,
c is the N-terminal amino acid residue of the second portion of the FVIII protein but is also the C-terminal amino acid residue of the two amino acids of an insertion site in which the XTEN sequence is inserted, and
d is the C-terminal amino acid residue of the FVIII protein, and
wherein the first portion of the FVIII protein and the second portion of the FVIII protein are not identical to each other and are of sufficient length together such that the FVIII protein has a FVIII coagulation activity.

In one embodiment, the first portion of the FVIII protein and the second portion of the FVIII protein are fragments of SEQ ID NO: 65 [full length mature FVIII sequence] or SEQ ID NO: 67 [B-domain deleted FVIII], e.g., N-terminal portion and C-terminal portion, respectively. In certain embodiments, the first portion of the FVIII protein comprises the A1 domain and the A2 domain of the FVIII protein. The second portion of the FVIII protein comprises the A3 domain, the C1 domain, and optionally the C2 domain. In yet other embodiments, the first portion of the FVIII protein comprises the A1 domain and A2 domain, and the second portion of the FVIII protein comprises a portion of the B domain, the A3 domain, the C1 domain, and optionally the C2 domain. In still other embodiments, the first portion of the FVIII protein comprises the A1 domain, A2 domain, and a portion of the B domain of the FVIII protein, and the second portion of the FVIII protein comprises the A3 domain, the C1 domain, and optionally the C2 domain. In still other embodiments, the first portion of the FVIII protein comprises the A1 domain, A2 domain, and a first portion of the B domain of the FVIII protein. The second portion of the FVIII protein comprises a second portion of the B domain, the A3 domain, the C1 domain, and optionally the C2 domain. In some embodiments, the two amino acids ("b" and "c") can be any one or more of the amino acid residues insertion sites shown in Tables 7, 8, 9, 10, 11, 12, 13, 14, and 15. For example, "b" can be the amino acid residue immediately upstream of the site in which one or more XTEN sequences are inserted or linked, and "c" can be the amino acid residue immediately downstream of the site in which the one or more XTEN sequences are inserted or linked. In some embodiments, "a" is the first mature amino acid sequence of a FVIII protein, and "d" is the last amino acid sequence of a FVIII protein. For example, FVIII$_{(a \to b)}$ can be an amino acid sequence at least 70%, 80%, 90%, 95%, 96%, 97%, 98%, 99%, or 100% identical to amino acids 1 to 745 of SEQ ID NO: 67 [B domain deleted FVIII amino acid sequence] or SEQ ID NO: 65 [full length FVIII] and FVIII$_{(c \to d)}$ can be amino acids 746 to 1438 of SEQ ID NO: 67 or amino acids 1641 to 2332 of SEQ ID NO: 65, respectively.

In some aspects, the insertion site in the FVIII protein is located in one or more domains of the FVIII protein, which is the N-terminus, the A1 domain, the A2 domain, the A3 domain, the B domain, the C1 domain, the C2 domain, the C-terminus, or two or more combinations thereof or between two domains of the FVIII protein, which are the A1 domain and a1 acidic region, and the a1 acidic region and A2 domain, the A2 domain and a2 acidic region, the a2 acidic region and B domain, the B domain and A3 domain, and the A3 domain and C1 domain, the C1 domain and C2 domain, or any combinations thereof. For example, the insertion sites in which the XTEN sequence can be inserted are selected from the group consisting of the N-terminus and A1 domain, the N-terminus and A2 domain, the N-terminus and A3 domain, the N-terminus and B domain, the N-terminus and C1 domain, the N-terminus and C2 domain, the N-terminus and the C-terminus, the A1 and A2 domains, the A1 and A3 domains, the A1 and B domains, the A1 and C1 domains, the A1 and C2 domains, the A1 domain and the C-terminus, the A2 and A3 domains, the A2 and B domains, the A2 and C1 domains, the A2 and C2 domains, the A2 domain and the C-terminus, the A3 and B domains, the A3 and C1 domains, the A3 and C2 domains, the A3 domain and the C-terminus, the B and C1 domains, the B and C2 domains, the B domain and the C-terminus, the C1 and C2 domains, the C1 and the C-terminus, the C2 domain, and the C-terminus, and two or more combinations thereof. Non-limiting examples of the insertion sites are listed in Tables 7, 8, 9, 10, 11, 12, 13, 14, and 15.

The FVIII protein, in which the XTEN sequence is inserted immediately downstream of one or more amino acids (e.g., one or more XTEN insertion sites) in the FVIII protein or linked at the C-terminus or the N-terminus, retains the FVIII activity after linkage to or insertion by the XTEN sequence. The XTEN sequence can be inserted in the FVIII protein once or more than once, twice, three times, four times, five times, or six times such that the insertions do not affect the FVIII activity (i.e., the FVIII protein still retains the coagulation property).

The FVIII protein useful in the present invention can be linked to one or more XTEN polypeptides at the N-terminus or C-terminus of the FVIII protein by an optional linker or inserted immediately downstream of one or more amino acids (e.g., one or more XTEN insertion sites) in the FVIII protein by one or more optional linkers. In one embodiment, the two amino acid residues in which the XTEN sequence is inserted or the amino acid residue to which the XTEN sequence is linked correspond to the two or one amino acid residues of SEQ ID NO: 65 [full length mature FVIII] selected from the group consisting of the residues in Table 7, Table 8, Table 9, and Table 10 and any combinations thereof.

In other embodiments, at least one XTEN sequence is inserted in any one or more XTEN insertion sites disclosed herein or any combinations thereof. In one aspect, at least one XTEN sequence is inserted in one or more XTEN insertion sites disclosed in one or more amino acids disclosed in Table 7.

TABLE 7

Exemplary XTEN Insertion Sites

| No. | XTEN Insertion Point* | Insertion Residue | FVIII BDD Downstream Sequence | FVIII Domain |
|---|---|---|---|---|
| 1 | 0 | (N-terminus) | ATR | A1 |
| 2 | 3 | R | RYY | A1 |
| 3 | 17 | M | QSD | A1 |
| 4 | 18 | Q | SDL | A1 |
| 5 | 22 | G | ELP | A1 |
| 6 | 24 | L | PVD | A1 |
| 7 | 26 | V | DAR | A1 |
| 8 | 28 | A | RFP | A1 |

TABLE 7-continued

Exemplary XTEN Insertion Sites

| No. | XTEN Insertion Point* | Insertion Residue | FVIII BDD Downstream Sequence | FVIII Domain |
|---|---|---|---|---|
| 9 | 32 | P | RVP | A1 |
| 10 | 38 | F | PFN | A1 |
| 11 | 40 | F | NTS | A1 |
| 12 | 41 | N | TSV | A1 |
| 13 | 60 | N | IAK | A1 |
| 14 | 61 | I | AKP | A1 |
| 15 | 65 | R | PPW | A1 |
| 16 | 81 | Y | DTV | A1 |
| 17 | 111 | G | AEY | A1 |
| 18 | 116 | D | QTS | A1 |
| 19 | 119 | S | QRE | A1 |
| 20 | 120 | Q | REK | A1 |
| 21 | 128 | V | FPG | A1 |
| 22 | 129 | F | PGG | A1 |
| 23 | 130 | P | GGS | A1 |
| 24 | 182 | G | SLA | A1 |
| 25 | 185 | A | KEK | A1 |
| 26 | 188 | K | TQT | A1 |
| 27 | 205 | G | KSW | A1 |
| 28 | 210 | S | ETK | A1 |
| 29 | 211 | E | TKN | A1 |
| 30 | 216 | L | MQD | A1 |
| 31 | 220 | R | DAA | A1 |
| 32 | 222 | A | ASA | A1 |
| 33 | 223 | A | SAR | A1 |
| 34 | 224 | S | ARA | A1 |
| 35 | 230 | K | MHT | A1 |
| 36 | 243 | P | GLI | A1 |
| 37 | 244 | G | LIG | A1 |
| 38 | 250 | R | KSV | A1 |
| 39 | 318 | D | GME | A1 |
| 40 | 333 | P | QLR | A1 |
| 42 | 334 | Q | LRM | A1 |
| 43 | 336 | R | MKN | a1 |
| 44 | 339 | N | NEE | a1 |
| 45 | 345 | D | YDD | a1 |
| 46 | 357 | V | VRF | a1 |

TABLE 7-continued

Exemplary XTEN Insertion Sites

| No. | XTEN Insertion Point* | Insertion Residue | FVIII BDD Downstream Sequence | FVIII Domain |
|---|---|---|---|---|
| 47 | 367 | S | FIQ | a1 |
| 48 | 370 | S | RPY | a1 |
| 49 | 375 | A | KKH | A2 |
| 50 | 376 | K | KHP | A2 |
| 51 | 378 | H | PKT | A2 |
| 52 | 399 | V | LAP | A2 |
| 53 | 403 | D | DRS | A2 |
| 54 | 405 | R | SYK | A2 |
| 55 | 409 | S | QYL | A2 |
| 56 | 416 | P | QRI | A2 |
| 57 | 434 | E | TFK | A2 |
| 58 | 438 | T | REA | A2 |
| 59 | 441 | A | IQH | A2 |
| 60 | 442 | I | QHE | A2 |
| 61 | 463 | I | IFK | A2 |
| 62 | 487 | Y | SRR | A2 |
| 63 | 490 | R | LPK | A2 |
| 64 | 492 | P | KGV | A2 |
| 65 | 493 | K | GVK | A2 |
| 66 | 494 | G | VKH | A2 |
| 67 | 500 | D | FPI | A2 |
| 68 | 506 | G | EIF | A2 |
| 69 | 518 | E | DGP | A2 |
| 70 | 556 | K | ESV | A2 |
| 71 | 565 | Q | IMS | A2 |
| 72 | 566 | I | MSD | A2 |
| 73 | 598 | P | AGV | A2 |
| 74 | 599 | A | GVQ | A2 |
| 75 | 603 | L | EDP | A2 |
| 76 | 616 | S | ING | A2 |
| 77 | 686 | G | LWI | A2 |
| 78 | 713 | K | NTG | A2 |
| 79 | 719 | Y | EDS | A2 |
| 80 | 730 | L | LSK | A2 |
| 81 | 733 | K | NNA | A2 |
| 82 | 745 | N | PPV** | B |
| 83 | 1640 | P | PVL | B |
| 84 | 1652 | R | TTL | B |
| 85 | 1656 | Q | SDQ | A3 |
| 86 | 1685 | N | QSP | A3 |
| 87 | 1711 | M | SSS | A3 |
| 88 | 1713 | S | SPH | A3 |
| 89 | 1720 | N | RAQ | A3 |
| 90 | 1724 | S | GSV | A3 |
| 91 | 1725 | G | SVP | A3 |
| 92 | 1726 | S | VPQ | A3 |
| 93 | 1741 | G | SFT | A3 |
| 94 | 1744 | T | QPL | A3 |
| 95 | 1749 | R | GEL | A3 |
| 96 | 1773 | V | TFR | A3 |
| 97 | 1792 | Y | EED | A3 |
| 98 | 1793 | E | EDQ | A3 |
| 99 | 1796 | Q | RQG | A3 |
| 100 | 1798 | Q | GAE | A3 |
| 101 | 1799 | G | AEP | A3 |
| 102 | 1802 | P | RKN | A3 |
| 103 | 1803 | R | KNF | A3 |
| 104 | 1807 | V | KPN | A3 |
| 105 | 1808 | K | PNE | A3 |
| 106 | 1827 | K | DEF | A3 |
| 107 | 1844 | E | KDV | A3 |
| 108 | 1861 | N | TLN | A3 |
| 109 | 1863 | L | NPA | A3 |
| 110 | 1896 | E | RNC | A3 |
| 111 | 1900 | R | APC | A3 |
| 112 | 1904 | N | IQM | A3 |
| 113 | 1905 | I | QME | A3 |
| 114 | 1910 | P | TFK | A3 |
| 115 | 1920 | A | ING | A3 |
| 116 | 1937 | D | QRI | A3 |
| 117 | 1981 | G | VFE | A3 |
| 118 | 2019 | N | KCQ | A3 |
| 119 | 2020 | K | CQT | C1 |
| 120 | 2044 | G | QWA | C1 |

TABLE 7-continued

Exemplary XTEN Insertion Sites

| No. | XTEN Insertion Point* | Insertion Residue | FVIII BDD Downstream Sequence | FVIII Domain |
|---|---|---|---|---|
| 121 | 2068 | F | SWI | C1 |
| 122 | 2073 | V | DLL | C1 |
| 123 | 2090 | R | QKF | C1 |
| 124 | 2092 | K | FSS | C1 |
| 125 | 2093 | F | SSL | C1 |
| 126 | 2111 | K | WQT | C1 |
| 127 | 2115 | Y | RGN | C1 |
| 128 | 2120 | T | GTL | C1 |
| 129 | 2125 | V | FFG | C1 |
| 130 | 2171 | L | NSC | C1 |
| 131 | 2173 | S | CSM | C2 |
| 132 | 2188 | A | QIT | C2 |
| 133 | 2223 | V | NNP | C2 |
| 134 | 2224 | N | NPK | C2 |
| 135 | 2227 | K | EWL | C2 |
| 136 | 2268 | G | HQW | C2 |
| 137 | 2277 | N | GKV | C2 |
| 138 | 2278 | G | KVK | C2 |
| 139 | 2290 | F | TPV | C2 |
| 140 | 2332 | Y | C terminus of FVIII | CT |

*Indicates an insertion point for XTEN based on the amino acid number of mature full-length human FVIII, wherein the insertion could be either on the N- or C-terminal side of the indicated amino acid.

In some embodiments, one or more XTEN sequences are inserted within about six amino acids up or down from amino acids 32, 220, 224, 336, 339, 399, 416, 603, 1656, 1711, 1725, 1905, or 1910, corresponding to SEQ ID NO: 65 or any combinations thereof.

TABLE 8

Exemplary XTEN Insertion Ranges

| No. | XTEN Insertion Point | Insertion Residue | FVIII BDD Downstream Sequence | FVIII Domain | Distance from insertion residue* |
|---|---|---|---|---|---|
| 9 | 32 | P | RVP | A1 | −3, +6 |
| 31 | 220 | R | DAA | A1 | — |
| 34 | 224 | S | ARA | A1 | +5 |
| 43 | 336 | R | MKN | a1 | −1, +6 |
| 44 | 339 | N | NEE | a1 | −4, +5 |
| 52 | 399 | V | LAP | A2 | −6, +3 |
| 56 | 416 | P | QRI | A2 | +6 |
| 75 | 603 | L | EDP | A2 | −6, +6 |
| 85 | 1656 | Q | SDQ | B | −3, +6 |
| 87 | 1711 | M | SSS | A3 | −6, +1 |
| 91 | 1725 | G | SVP | A3 | +6 |
| 113 | 1905 | I | QME | A3 | +6 |
| 114 | 1910 | P | TFK | A3 | −5, +6 |

*Distance from insertion residue refers to the relative number of amino acids away from the N-terminus (negative numbers) or C-terminus (positive numbers) of the designated insertion residue (residue "0") where an insertion may be made. The designation "−x" refers to an insertion site which is x amino acids away on the N-terminal side of the designated insertion residue. Similarly, the designation "+x" refers to an insertion site which is x amino acids away on the C-terminal side of the designated insertion residue. For example, "−1, +2" indicates that the insertion is made at the N-terminus or C-terminus of amino acid residues denoted −1, 0, +1 or +2.

In other embodiments, one or more XTEN sequences are inserted immediately down stream of one or more amino acids corresponding to the full-length mature human FVIII selected from the group consisting of one or more insertion sites in Table 9.

TABLE 9

Exemplary XTEN Insertion Sites or Ranges

| No. | XTEN Insertion Point Range* | First Insertion Residue | FVIII Domain |
|---|---|---|---|
| 3 | 18-32 | Q | A1 |
| 8 | 40 | F | A1 |
| 18 | 211-224 | E | A1 |
| 27 | 336-403 | R | A1, A2 |
| 43 | 599 | A | A2 |
| 47 | 745-1640 | N | B |
| 50 | 1656-1728 | Q | B, a3, A3 |
| 57 | 1796-1804 | R | A3 |
| 65 | 1900-1912 | R | A3 |
| 81 | 2171-2332 | L | C1, C2 |

*indicates range of insertion sites numbered relative to the amino acid number of mature human FVIII In yet other embodiments, one or more XTENs are inserted in the B domain of FVIII. In one example, an XTEN 15 inserted between amino acids 740 and 1640 corresponding to SEQ ID NO: 65, wherein the FVIII sequence between amino acids 740 and 1640 is optionally not present. In another example, an XTEN is inserted between amino acids 741 and 1690 corresponding to SEQ ID NO: 65, wherein the FVIII sequence between amino acids 740 and 1690 is optionally not present. In other examples, an XTEN is inserted between amino acids 741 and 1648 corresponding to SEQ ID NO: 65, wherein the FVIII sequence between amino acids 741 and 1648 is optionally not present. In yet other examples, an XTEN is inserted between amino acids 743 and 1638 corresponding to SEQ ID NO: 65, wherein the FVIII sequence between amino acids 743 and 1638 is optionally not present. In still other examples, an XTEN is inserted between amino acids 745 and 1656 corresponding to SEQ ID NO: 65, wherein the FVIII sequence between amino acids 745 and 1656 is optionally not present. In some examples, an XTEN is inserted between amino acids 745 and 1657 corresponding to SEQ ID NO: 65, wherein the FVIII sequence between amino acids 745 and 1657 is optionally not present. In certain examples, an XTEN is inserted between amino acids 745 and 1667 corresponding to SEQ ID NO: 65, wherein the FVIII sequence between amino acids 745 and 1667 is optionally not present. In still other examples, an XTEN is inserted between amino acids 745 and 1686 corresponding to SEQ ID NO: 65, wherein the FVIII sequence between amino acids 745 and 1686 is optionally not present. In some other examples, an XTEN is inserted between amino acids 747 and 1642 corresponding to SEQ ID NO: 65, wherein the FVIII sequence between amino acids 747 and 1642 is optionally not present. In still other examples, an XTEN 15 inserted between amino acids 751 and 1667 corresponding to SEQ ID NO: 65, wherein the FVIII sequence between amino acids 751 and 1667 is optionally not present.

In some embodiments, one or more XTENs are inserted in one or more amino acids immediately downstream of an amino acid of an insertion site selected from the group consisting of the amino acid residues in Table 10.

TABLE 10

FVIII XTEN insertion sites and construct designations

| Construct Number | Domain | Upstream Residue No.* | Downstream Residue No.* | Upstream Sequence | Downstream Sequence |
|---|---|---|---|---|---|
| F8X-1 | A1 | 3 | 4 | ATR | RYY |
| F8X-2 | A1 | 18 | 19 | YMQ | SDL |
| F8X-3 | A1 | 22 | 23 | DLG | ELP |
| F8X-4 | A1 | 26 | 27 | LPV | DAR |
| F8X-5 | A1 | 40 | 41 | FPF | NTS |
| F8X-6 | A1 | 60 | 61 | LFN | IAK |
| F8X-7 | A1 | 116 | 117 | YDD | QTS |
| F8X-8 | A1 | 130 | 131 | VFP | GGS |
| F8X-9 | A1 | 188 | 189 | KEK | TQT |
| F8X-10 | A1 | 216 | 217 | NSL | MQD |
| F8X-11 | A1 | 230 | 231 | WPK | MHT |
| F8X-12 | A1 | 333 | 334 | EEP | QLR |
| F8X-13 | A2 | 375 | 376 | SVA | KKH |
| F8X-14 | A2 | 403 | 404 | APD | DRS |
| F8X-15 | A2 | 442 | 443 | EAI | QHE |
| F8X-16 | A2 | 490 | 491 | RRL | PKG |
| F8X-17 | A2 | 518 | 519 | TVE | DGP |
| F8X-18 | A2 | 599 | 600 | NPA | GVQ |
| F8X-19 | A2 | 713 | 714 | CDK | NTG |
| F8X-20 | BD | 745 | 746 | SQN | PPV |
| F8X-21 | BD | 745 | 746 | SQN | PPV |
| F8X-22 | BD** | 745 | 746 | SQN | PPV |
| F8X-23 | A3 | 1720 | 1721 | APT | KDE |
| F8X-24 | A3 | 1796 | 1797 | EDQ | RQG |
| F8X-25 | A3 | 1802 | 1803 | AEP | RKN |
| F8X-26 | A3 | 1827 | 1828 | PTK | DEF |
| F8X-27 | A3 | 1861 | 1862 | HTN | TLN |
| F8X-28 | A3 | 1896 | 1897 | NME | RNC |
| F8X-29 | A3 | 1900 | 1901 | NCR | APC |
| F8X-30 | A3 | 1904 | 1905 | PCN | IQM |
| F8X-31 | A3 | 1937 | 1938 | AQD | QRI |
| F8X-32 | C1 | 2019 | 2020 | YSN | KCQ |
| F8X-33 | C1 | 2068 | 2069 | EPF | SWI |
| F8X-34 | C1 | 2111 | 2112 | GKK | WQT |
| F8X-35 | C1 | 2120 | 2121 | NST | GTL |
| F8X-36 | C2 | 2171 | 2172 | CDL | NSC |
| F8X-37 | C2 | 2188 | 2189 | SDA | QIT |
| F8X-38 | C2 | 2227 | 2228 | NPK | EWL |
| F8X-39 | C2 | 2277 | 2278 | FQN | GKV |
| F8X-40 | CT | 2332 | NA | DLY | NA |
| F8X-41 | CT | 2332 | NA | DLY | NA |
| F8X-42 | A1 | 3 | 4 | ATR | ATR |
| pSD0001 | A2 | 403 | 404 | | |
| pSD0002 | A2 | 599 | 600 | | |
| pSD0021 | N-term | 0 | 1 | | |
| pSD0022 | A1 | 32 | 33 | | |
| pSD0023 | A1 | 65 | 66 | | |
| pSD0024 | A1 | 81 | 82 | | |
| pSD0025 | A1 | 119 | 120 | | |
| pSD0026 | A1 | 211 | 212 | | |
| pSD0027 | A1 | 220 | 221 | | |
| pSD0028 | A1 | 224 | 225 | | |
| pSD0029 | A1 | 336 | 337 | | |
| pSD0030 | A1 | 339 | 340 | | |
| pSD0031 | A2 | 378 | 379 | | |
| pSD0032 | A2 | 399 | 400 | | |
| pSD0033 | A2 | 409 | 410 | | |

TABLE 10-continued

FVIII XTEN insertion sites and construct designations

| Construct Number | Domain | Upstream Residue No.* | Downstream Residue No.* | Upstream Sequence | Downstream Sequence |
|---|---|---|---|---|---|
| pSD0034 | A2 | 416 | 417 | | |
| pSD0035 | A2 | 487 | 488 | | |
| pSD0036 | A2 | 494 | 495 | | |
| pSD0037 | A2 | 500 | 501 | | |
| pSD0038 | A2 | 603 | 604 | | |
| pSD0039 | A3 | 1656 | 1657 | | |
| pSD0040 | A3 | 1711 | 1712 | | |
| pSD0041 | A3 | 1725 | 1726 | | |
| pSD0042 | A3 | 1749 | 1750 | | |
| pSD0043 | A3 | 1905 | 1906 | | |
| pSD0044 | A3 | 1910 | 1911 | | |
| pDS0062 | A3 | 1900 | 1901 | | |

*Indicates the amino acid number of the mature FVIII protein

In one embodiment, the one or more XTEN insertion sites are located within one or more surface-exposed, flexible loop structure of the FVIII protein (e.g., a permissive loop). For example, at least one XTEN sequence can be inserted in each FVIII "A" domain comprising at least two "permissive loops" into which at least one XTEN polypeptide can be inserted without eliminating procoagulant activity of the recombinant protein, or the ability of the recombinant proteins to be expressed in vivo or in vitro in a host cell. The permissive loops are regions that allow insertion of at least one XTEN sequence with, among other attributes, high surface or solvent exposure and high conformational flexibility. The A1 domain comprises a permissive loop-1 (A1-1) region and a permissive loop-2 (A1-2) region, the A2 domain comprises a permissive loop-1 (A2-1) region and a permissive loop-2 (A2-2) region, the A3 domain comprises a permissive loop-1 (A3-1) region and a permissive loop-2 (A3-2) region.

In one aspect, a first permissive loop in the FVIII A1 domain (A1-1) is located between beta strand 1 and beta strand 2, and a second permissive loop in the FVIII A2 domain (A1-2) is located between beta strand 11 and beta strand 12. A first permissive loop in the FVIII A2 domain (A2-1) is located between beta strand 22 and beta strand 23, and a second permissive loop in the FVIII A2 domain (A2-2) is located between beta strand 32 and beta strand 33. A first permissive loop in the FVIII A3 domain (A3-1) is located between beta strand 38 and beta strand 39, and a second permissive loop in the FVIII A3 (A3-2) is located between beta strand 45 and beta strand 46. In certain aspects, the surface-exposed, flexible loop structure comprising A1-1 corresponds to a region in native mature human FVIII from about amino acid 15 to about amino acid 45 of SEQ ID NO: 65, e.g., from about amino acid 18 to about amino acid 41 of SEQ ID NO: 65. In other aspects, the surface-exposed, flexible loop structure comprising A1-2 corresponds to a region in native mature human FVIII from about amino acid 201 to about amino acid 232 of SEQ ID NO: 65, e.g., from about amino acid 218 to about amino acid 229 of SEQ ID NO: 65. In yet other aspects, the surface-exposed, flexible loop structure comprising A2-1 corresponds to a region in native mature human FVIII from about amino acid 395 to about amino acid 421 of SEQ ID NO: 65, e.g. from about amino acid 397 to about amino acid 418 of SEQ ID NO: 65. In still other embodiments, the surface-exposed, flexible loop structure comprising A2-2 corresponds to a region in native mature human FVIII from about amino acid 577 to about amino acid 635 of SEQ ID NO: 65, e.g., from about amino acid 595 to about amino acid 607 of SEQ ID NO: 65. In certain aspects the surface-exposed, flexible loop structure comprising A3-1 corresponds to a region in native mature human FVIII from about amino acid 1705 to about amino acid 1732 of SEQ ID NO: 65, e.g., from about amino acid 1711 to about amino acid 1725 of SEQ ID NO: 65. In yet other aspects, the surface-exposed, flexible loop structure comprising A3-2 corresponds to a region in native mature human FVIII from about amino acid 1884 to about amino acid 1917 of SEQ ID NO: 65, e.g., from about amino acid 1899 to about amino acid 1911 of SEQ ID NO: 65.

In another embodiment, the one or more amino acids in which at least one XTEN sequence is inserted is located within a3 domain, e.g., amino acids 1649 to 1689, corresponding to full-length mature FVIII polypeptide. In a particular embodiment, an XTEN sequence is inserted between amino acids 1656 and 1657 of SEQ ID NO: 65 (full-length mature FVIII). In a specific embodiment, a FVIII protein comprising an XTEN sequence inserted immediately downstream of amino acid 1656 corresponding to SEQ ID NO: 65 further comprises a deletion from amino acid 745 to amino acid 1656 corresponding to SEQ ID NO: 65.

In some embodiments, the one or more insertion sites for one or more XTEN insertions are immediately downstream of one or more amino acids corresponding to mature full-length FVIII, selected from the group consisting of:

(1) amino acid 3, (2) amino acid 18, (3) amino acid 22,
(4) amino acid 26, (5) amino acid 32, (6) amino acid 40,
(7) amino acid 60, (8) amino acid 65, (9) amino acid 81,
(10) amino acid 116, (11) amino acid 119, (12) amino acid 130,
(13) amino acid 188, (14) amino acid 211, (15) amino acid 216,
(16) amino acid 220, (17) amino acid 224, (18) amino acid 230,
(19) amino acid 333, (20) amino acid 336, (21) amino acid 339,
(22) amino acid 375, (23) amino acid 399, (24) amino acid 403,
(25) amino acid 409, (26) amino acid 416, (26) amino acid 442,
(28) amino acid 487, (29) amino acid 490, (30) amino acid 494,
(31) amino acid 500, (32) amino acid 518, (33) amino acid 599,
(34) amino acid 603, (35) amino acid 713, (36) amino acid 745,
(37) amino acid 1656, (38) amino acid 1711, (39) amino acid 1720,
(40) amino acid 1725, (41) amino acid 1749, (42) amino acid 1796,
(43) amino acid 1802, (44) amino acid 1827, (45) amino acid 1861,
(46) amino acid 1896, (47) amino acid 1900, (48) amino acid 1904,
(49) amino acid 1905, (50) amino acid 1910, (51) amino acid 1937,
(52) amino acid 2019, (53) amino acid 2068, (54) amino acid 2111,
(55) amino acid 2120, (56) amino acid 2171, (57) amino acid 2188,
(58) amino acid 2227, (59) amino acid 2277, and
(60) two or more combinations thereof.

In one embodiment, a FVIII protein useful for the invention comprises two XTEN sequences, a first XTEN sequence inserted into a first XTEN insertion site and a second XTEN inserted into a second XTEN insertion site. Non-limiting examples of the first XTEN insertion site and the second XTEN insertion site are listed in Table 11.

TABLE 11

Exemplary Insertion Sites for Two XTENs

| Insertion 1 | | Insertion 2 | |
|---|---|---|---|
| Insertion Site | Domain | Insertion Site | Domain |
| 745 | B | 2332 | CT |
| 26 | A1 | 403 | A2 |
| 40 | A1 | 403 | A2 |
| 18 | A1 | 403 | A2 |
| 26 | A1 | 599 | A2 |
| 40 | A1 | 599 | A2 |
| 18 | A1 | 599 | A2 |
| 1720 | A3 | 1900 | A3 |
| 1725 | A3 | 1900 | A3 |
| 1711 | A3 | 1905 | A3 |
| 1720 | A3 | 1905 | A3 |
| 1725 | A3 | 1905 | A3 |
| 1656 | A3 | 26 | A1 |
| 1656 | A3 | 18 | A1 |
| 1656 | A3 | 40 | A1 |
| 1656 | A3 | 399 | A2 |
| 1656 | A3 | 403 | A2 |
| 1656 | A3 | 1725 | A3 |
| 1656 | A3 | 1720 | A3 |
| 1900 | A3 | 18 | A1 |
| 1900 | A3 | 26 | A1 |
| 1900 | A3 | 40 | A1 |
| 1905 | A3 | 18 | A1 |
| 1905 | A3 | 40 | A1 |
| 1905 | A3 | 26 | A1 |
| 1910 | A3 | 26 | A1 |
| 18 | A1 | 399 | A2 |
| 26 | A1 | 399 | A2 |
| 40 | A1 | 399 | A2 |
| 18 | A1 | 403 | A2 |
| 1656 | A3 | 1900 | A3 |
| 1656 | A3 | 1905 | A3 |
| 1711 | A3 | 40 | A1 |
| 1711 | A3 | 26 | A1 |
| 1720 | A3 | 26 | A1 |
| 1720 | A3 | 40 | A1 |
| 1720 | A3 | 18 | A1 |
| 1725 | A3 | 26 | A1 |
| 1725 | A3 | 40 | A1 |
| 1725 | A3 | 18 | A1 |
| 1720 | A3 | 403 | A2 |
| 1720 | A3 | 399 | A2 |
| 1711 | A3 | 403 | A2 |
| 1720 | A3 | 403 | A2 |
| 1725 | A3 | 403 | A2 |
| 1725 | A3 | 399 | A2 |
| 1711 | A3 | 403 | A2 |
| 1900 | A3 | 399 | A2 |
| 1900 | A3 | 403 | A2 |
| 1905 | A3 | 403 | A2 |
| 1905 | A3 | 399 | A2 |
| 1910 | A3 | 403 | A2 |

The two XTENs inserted or linked to the FVIII protein can be identical or different. In some embodiments, a FVIII protein useful for the invention comprises two XTEN sequences inserted in the FVIII protein, a first XTEN sequence inserted immediately downstream of amino acid 745 corresponding to SEQ ID NO: 65, and a second XTEN sequence inserted immediately downstream of amino acid 2332 corresponding to SEQ ID NO: 65 (the C-terminus). In other embodiments, the first XTEN sequence is inserted immediately downstream of amino acid 18, 26, 40, 1656, or 1720 corresponding to SEQ ID NO: 65, and a second XTEN sequence inserted immediately downstream of amino acid 403 corresponding to SEQ ID NO: 65. In yet other embodiments, the first XTEN sequence is inserted immediately downstream of amino acid 18, 26, or 40 corresponding to SEQ ID NO: 65, and a second XTEN sequence inserted immediately downstream of amino acid 599 corresponding to SEQ ID NO: 65. In still other embodiments, the first XTEN sequence is inserted immediately downstream of amino acid 1656 corresponding to SEQ ID NO: 65, and a second XTEN sequence inserted immediately downstream of amino acid 18, 26, 40, 399, 403, 1725, 1720, 1900, 1905, or 2332 corresponding to SEQ ID NO: 65. In certain embodiments, the first XTEN sequence is inserted immediately downstream of amino acid 1900 corresponding to SEQ ID NO: 65, and a second XTEN sequence inserted immediately downstream of amino acid 18, 26, or 40 corresponding to SEQ ID NO: 65. In some embodiments, the first XTEN sequence is inserted immediately downstream of amino acid 18, 26, or 40 corresponding to SEQ ID NO: 65, and a second XTEN sequence inserted immediately downstream of amino acid 399 corresponding to SEQ ID NO: 65. In other embodiments, the first XTEN sequence is inserted immediately downstream of amino acid 1720 corresponding to SEQ ID NO: 65, and a second XTEN sequence inserted immediately downstream of amino acid 18, 26, or 40 corresponding to SEQ ID NO: 65. In still other embodiments, the first XTEN sequence is inserted immediately downstream of amino acid 1720 corresponding to SEQ ID NO: 65, and a second XTEN sequence inserted immediately downstream of amino acid 18 corresponding to SEQ ID NO: 65. In a particular embodiment, the FVIII protein comprising two XTEN sequences, a first XTEN sequence inserted immediately downstream of amino acid 745 corresponding to SEQ ID NO: 65 and a second XTEN sequence inserted immediately downstream of amino acid 2332 corresponding to SEQ ID NO: 65, wherein the FVIII protein further has a deletion from amino acid 745 corresponding to SEQ ID NO: 65 to amino acid 1685 corresponding to SEQ ID NO: 65, a mutation or substitution at amino acid 1680 corresponding to SEQ ID NO: 65, e.g., Y1680F, a mutation or substitution at amino acid 1648 corresponding to SEQ ID NO: 65, e.g., R1648A, or at least two mutations or substitutions at amino acid 1648 corresponding to SEQ ID NO: 65, e.g., R1648A, and amino acid 1680 corresponding to SEQ ID NO: 65, e.g., Y1680F. In a specific embodiment, the FVIII protein comprises two XTEN sequences, a first XTEN inserted immediately downstream of amino acid 1656 corresponding to SEQ ID NO: 65 and a second XTEN sequence inserted immediately downstream of amino acid 2332 of SEQ ID NO: 65, wherein the FVIII protein further has a deletion from amino acid 745 to amino acid 1656 corresponding to SEQ ID NO: 65.

In certain embodiments, a FVIII protein comprises three XTEN sequences, a first XTEN sequence inserted into a first XTEN insertion site, a second XTEN sequence inserted into a second XTEN sequence, and a third XTEN sequence inserted into a third XTEN insertion site. The first, second, or third XTEN sequences can be identical or different. The first, second, and third insertion sites can be selected from the group of any one of the insertion sites disclosed herein. In some embodiments, the FVIII protein comprising three XTEN sequences can further comprise a mutation or substitution, e.g., amino acid 1648 corresponding to SEQ ID NO: 65, e.g., R1648A. For example, non-limiting examples of the first, second, and third XTEN insertion sites are listed in Table 12.

TABLE 12

Exemplary Insertion Sites for Three XTENs

| Insertion 1 | | Insertion 2 | | Insertion 3 | |
|---|---|---|---|---|---|
| Insertion Site | Domain | Insertion Site | Domain | Insertion Site | Domain |
| 26 | A1 | 403 | A2 | 1656 | A3 |
| 26 | A1 | 403 | A2 | 1720 | A3 |
| 26 | A1 | 403 | A2 | 1900 | A3 |
| 26 | A1 | 1656 | A3 | 1720 | A3 |
| 26 | A1 | 1656 | A3 | 1900 | A3 |
| 26 | A1 | 1720 | A3 | 1900 | A3 |
| 403 | A2 | 1656 | A3 | 1720 | A3 |
| 403 | A2 | 1656 | A3 | 1900 | A3 |
| 403 | A2 | 1720 | A3 | 1900 | A3 |
| 1656 | A3 | 1720 | A3 | 1900 | A3 |
| 745 | B | 1900 | | 2332 | |
| 18 | A1 | 745 | B | 2332 | CT |
| 26 | A1 | 745 | B | 2332 | CT |
| 40 | A1 | 745 | B | 2332 | CT |
| 18 | A1 | 745 | B | 2332 | CT |
| 40 | A1 | 745 | B | 2332 | CT |
| 403 | A2 | 745 | B | 2332 | CT |
| 399 | A2 | 745 | B | 2332 | CT |
| 1725 | A3 | 745 | B | 2332 | CT |
| 1720 | A3 | 745 | B | 2332 | CT |
| 1711 | A3 | 745 | B | 2332 | CT |
| 1900 | A3 | 745 | B | 2332 | CT |
| 1905 | A3 | 745 | B | 2332 | CT |
| 1910 | A3 | 745 | B | 2332 | CT |

In some embodiments, a FVIII protein comprises three XTEN sequences, a first XTEN sequence inserted immediately downstream of amino acid 26 corresponding to SEQ ID NO: 65, a second XTEN sequence inserted downstream of amino acid 403 corresponding to SEQ ID NO: 65, and a third XTEN sequence inserted downstream of amino acid 1656, 1720, or 1900 corresponding to SEQ ID NO: 65. In other embodiments, the first XTEN sequence is inserted immediately downstream of amino acid 26 corresponding to SEQ ID NO: 65, a second XTEN sequence is inserted downstream of amino acid 1656 corresponding to SEQ ID NO: 65, and a third XTEN sequence is inserted downstream of amino acid 1720 or 1900 corresponding to SEQ ID NO: 65. In yet other embodiments, the first XTEN sequence is inserted immediately downstream of amino acid 26 corresponding to SEQ ID NO: 65, a second XTEN sequence is inserted downstream of amino acid 1720 corresponding to SEQ ID NO: 65, and a third XTEN sequence is inserted downstream of amino acid 1900 corresponding to SEQ ID NO: 65. In still other embodiments, the first XTEN sequence is inserted immediately downstream of amino acid 403 corresponding to SEQ ID NO: 65, a second XTEN sequence is inserted downstream of amino acid 1656 corresponding to SEQ ID NO: 65, and a third XTEN sequence is inserted downstream of amino acid 1720 or 1900 corresponding to SEQ ID NO: 65. In other embodiments, the first XTEN sequence is inserted immediately downstream of amino acid 403 or 1656 corresponding to SEQ ID NO: 65, a second XTEN sequence is inserted downstream of amino acid 1720 corresponding to SEQ ID NO: 65, and a third XTEN sequence is inserted downstream of amino acid 1900 corresponding to SEQ ID NO: 65. In other embodiments, the first XTEN sequence is inserted immediately downstream of amino acid 18, 26, 40, 399, 403, 1711, 1720, 1725, 1900, 1905, or 1910 corresponding to SEQ ID NO: 65, a second XTEN sequence is inserted downstream of amino acid 745 corresponding to SEQ ID NO: 65, and a third XTEN sequence is inserted downstream of amino acid 2332 corresponding to SEQ ID NO: 65.

In other embodiments, a FVIII protein in the invention comprises four XTEN sequences, a first XTEN sequence inserted into a first insertion site, a second XTEN sequence inserted into a second insertion site, a third XTEN sequence inserted into a third insertion site, and a fourth XTEN sequence inserted into a fourth insertion site. The first, second, third, and fourth XTEN sequences can be identical, different, or combinations thereof. In some embodiments, the FVIII protein comprising four XTEN sequences can further comprise a mutation or substitution, e.g., amino acid 1648 corresponding to SEQ ID NO: 65, e.g., R1648A. Non-limiting examples of the first, second, third, and fourth XTEN insertion sites are listed in Table 13.

TABLE 13

Exemplary Insertion Sites for Four XTENs

| Insertion 1 | | Insertion 2 | | Insertion 3 | | Insertion 4 | |
|---|---|---|---|---|---|---|---|
| Insertion Site | Domain | Insertion Site | Domain | Insertion Site | Domain | Insertion Site | Domain |
| 26 | A1 | 403 | A2 | 1656 | a3 | 1720 | A3 |
| 26 | A1 | 403 | A2 | 1656 | a3 | 1900 | A3 |
| 26 | A1 | 403 | A2 | 1720 | A3 | 1900 | A3 |
| 26 | A1 | 1656 | a3 | 1720 | A3 | 1900 | A3 |
| 403 | A2 | 1656 | a3 | 1720 | A3 | 1900 | A3 |
| 0040 | A1 | 0403 | A2 | 745 | B | 2332 | CT |
| 0040 | A1 | 0403 | A2 | 745 | B | 2332 | CT |
| 0018 | A1 | 0409 | A2 | 745 | B | 2332 | CT |
| 0040 | A1 | 0409 | A2 | 745 | B | 2332 | CT |
| 0040 | A1 | 0409 | A2 | 745 | B | 2332 | CT |
| 0018 | A1 | 0409 | A2 | 745 | B | 2332 | CT |
| 0040 | A1 | 1720 | A3 | 745 | B | 2332 | CT |
| 0026 | A1 | 1720 | A3 | 745 | B | 2332 | CT |
| 0018 | A1 | 1720 | A3 | 745 | B | 2332 | CT |
| 0018 | A1 | 1720 | A3 | 745 | B | 2332 | CT |
| 0018 | A1 | 1720 | A3 | 745 | B | 2332 | CT |
| 0026 | A1 | 1720 | A3 | 745 | B | 2332 | CT |
| 0018 | A1 | 1720 | A3 | 745 | B | 2332 | CT |
| 0018 | A1 | 1900 | A3 | 745 | B | 2332 | CT |
| 0018 | A1 | 1900 | A3 | 745 | B | 2332 | CT |
| 0026 | A1 | 1900 | A3 | 745 | B | 2332 | CT |
| 0040 | A1 | 1900 | A3 | 745 | B | 2332 | CT |
| 0040 | A1 | 1905 | A3 | 745 | B | 2332 | CT |

TABLE 13-continued

| Exemplary Insertion Sites for Four XTENs | | | | | | | |
|---|---|---|---|---|---|---|---|
| Insertion 1 | | Insertion 2 | | Insertion 3 | | Insertion 4 | |
| Insertion Site | Domain | Insertion Site | Domain | Insertion Site | Domain | Insertion Site | Domain |
| 0018 | A1 | 1905 | A3 | 745 | B | 2332 | CT |
| 0040 | A1 | 1905 | A3 | 745 | B | 2332 | CT |
| 0026 | A1 | 1905 | A3 | 745 | B | 2332 | CT |
| 0018 | A1 | 1905 | A3 | 745 | B | 2332 | CT |
| 0018 | A1 | 1905 | A3 | 745 | B | 2332 | CT |
| 0018 | A1 | 1910 | A3 | 745 | B | 2332 | CT |
| 0018 | A1 | 1910 | A3 | 745 | B | 2332 | CT |
| 0040 | A1 | 1910 | A3 | 745 | B | 2332 | CT |
| 0026 | A1 | 1910 | A3 | 745 | B | 2332 | CT |
| 0018 | A1 | 1910 | A3 | 745 | B | 2332 | CT |
| 0026 | A1 | 1910 | A3 | 745 | B | 2332 | CT |
| 0040 | A1 | 1910 | A3 | 745 | B | 2332 | CT |
| 0018 | A1 | 1910 | A3 | 745 | B | 2332 | CT |
| 0409 | A2 | 1720 | A3 | 745 | B | 2332 | CT |
| 0403 | A2 | 1720 | A3 | 745 | B | 2332 | CT |
| 0409 | A2 | 1720 | A3 | 745 | B | 2332 | CT |
| 0403 | A2 | 1720 | A3 | 745 | B | 2332 | CT |
| 0403 | A2 | 1720 | A3 | 745 | B | 2332 | CT |
| 0403 | A2 | 1900 | A3 | 745 | B | 2332 | CT |
| 0403 | A2 | 1900 | A3 | 745 | B | 2332 | CT |
| 0409 | A2 | 1900 | A3 | 745 | B | 2332 | CT |
| 0403 | A2 | 1900 | A3 | 745 | B | 2332 | CT |
| 0403 | A2 | 1900 | A3 | 745 | B | 2332 | CT |
| 0409 | A2 | 1900 | A3 | 745 | B | 2332 | CT |
| 0409 | A2 | 1905 | A3 | 745 | B | 2332 | CT |
| 0403 | A2 | 1905 | A3 | 745 | B | 2332 | CT |
| 0403 | A2 | 1905 | A3 | 745 | B | 2332 | CT |
| 0403 | A2 | 1905 | A3 | 745 | B | 2332 | CT |
| 0409 | A2 | 1905 | A3 | 745 | B | 2332 | CT |
| 0403 | A2 | 1905 | A3 | 745 | B | 2332 | CT |
| 0409 | A2 | 1910 | A3 | 745 | B | 2332 | CT |
| 0403 | A2 | 1910 | A3 | 745 | B | 2332 | CT |
| 0403 | A2 | 1910 | A3 | 745 | B | 2332 | CT |
| 0403 | A2 | 1910 | A3 | 745 | B | 2332 | CT |
| 0403 | A2 | 1910 | A3 | 745 | B | 2332 | CT |
| 1720 | A3 | 1900 | A3 | 745 | B | 2332 | CT |
| 1720 | A3 | 1905 | A3 | 745 | B | 2332 | CT |
| 1720 | A3 | 1910 | A3 | 745 | B | 2332 | CT |
| 1720 | A3 | 1910 | A3 | 745 | B | 2332 | CT |
| 0403 | A2 | 1656 | a3 | 1720 | A3 | 2332 | CT |
| 0403 | A2 | 1656 | a3 | 1900 | A3 | 2332 | CT |
| 0403 | A2 | 1720 | A3 | 1900 | A3 | 2332 | CT |
| 1656 | a3 | 1720 | A3 | 1900 | A3 | 2332 | CT |
| 0018 | A1 | 0403 | A2 | 1656 | a3 | 2332 | CT |
| 0018 | A1 | 0403 | A2 | 1720 | A3 | 2332 | CT |
| 0018 | A1 | 0403 | A2 | 1900 | A3 | 2332 | CT |
| 0018 | A1 | 1656 | a3 | 1720 | A3 | 2332 | CT |
| 0018 | A1 | 1656 | a3 | 1900 | A3 | 2332 | CT |
| 0018 | A1 | 1720 | A3 | 1900 | A3 | 2332 | CT |
| 0018 | A1 | 0403 | A2 | 0745 | B | 2332 | CT |
| 0018 | A1 | 0745 | B | 1720 | A3 | 2332 | CT |
| 0018 | A1 | 0745 | B | 1900 | A3 | 2332 | CT |
| 0403 | A2 | 0745 | B | 1720 | A3 | 2332 | CT |
| 0403 | A2 | 0745 | B | 1900 | A3 | 2332 | CT |
| 0745 | B | 1720 | A3 | 1900 | A3 | 2332 | CT |
| 0188 | A1 | 1900 | A3 | 0745 | B | 2332 | CT |
| 0599 | | 1900 | A3 | 0745 | B | 2332 | CT |
| 2068 | | 1900 | A3 | 0745 | B | 2332 | CT |
| 2171 | | 1900 | A3 | 0745 | B | 2332 | CT |
| 2227 | | 1900 | A3 | 0745 | B | 2332 | CT |
| 2277 | | 1900 | A3 | 0745 | B | 2332 | CT |

In some embodiments, a FVIII protein comprises five XTEN sequences, a first XTEN sequence inserted into a first insertion site, a second XTEN sequence inserted into a second insertion site, a third XTEN sequence inserted into a third XTEN insertion site, a fourth XTEN sequence inserted into a fourth XTEN insertion site, and a fifth XTEN sequence inserted into a fifth XTEN insertion site. The first, second, third, fourth, of fifth XTEN sequences can be identical, different, or combinations thereof. Non-limiting examples of the first, second, third, fourth, and fifth insertion sites are listed in Table 14.

TABLE 14

Exemplary Insertion Sites for Five XTENs

| XTEN Insertion 1 | XTEN insertion 2 | XTEN Insertion 3 | XTEN Insertion 4 | XTEN Insertion 5 |
|---|---|---|---|---|
| 0403 | 1656 | 1720 | 1900 | 2332 |
| 0018 | 0403 | 1656 | 1720 | 2332 |
| 0018 | 0403 | 1656 | 1900 | 2332 |
| 0018 | 0403 | 1720 | 1900 | 2332 |
| 0018 | 1656 | 1720 | 1900 | 2332 |
| 0018 | 0403 | 0745 | 1720 | 2332 |
| 0018 | 0403 | 0745 | 1900 | 2332 |
| 0018 | 0745 | 1720 | 1900 | 2332 |
| 0403 | 0745 | 1720 | 1900 | 2332 |

In certain embodiments, a FVIII protein comprises six XTEN sequences, a first XTEN sequence inserted into a first XTEN insertion site, a second XTEN sequence inserted into a second XTEN insertion site, a third XTEN sequence inserted into a third XTEN insertion site, a fourth XTEN sequence inserted into a fourth XTEN insertion site, a fifth XTEN sequence inserted into a fifth XTEN insertion site, and a sixth XTEN sequence inserted into a sixth XTEN insertion site. The first, second, third, fourth, fifth, or sixth XTEN sequences can be identical, different, or combinations thereof. Examples of the six XTEN insertion sites include, but are not limited to the insertion sites listed in Table 15.

TABLE 15

Exemplary XTEN Insertion Sites for Six XTENs

| XTEN Insertion 1 | XTEN insertion 2 | XTEN Insertion 3 | XTEN Insertion 4 | XTEN Insertion 5 | XTEN Insertion 5 |
|---|---|---|---|---|---|
| 0018 | 0403 | 1656 | 1720 | 1900 | 2332 |
| 0018 | 0403 | 0745 | 1720 | 1900 | 2332 |

In a particular example, a first XTEN is inserted between amino acids 26 and 27 corresponding to SEQ ID NO: 65, and a second XTEN is inserted between amino acids 1720 and 1721 corresponding to SEQ ID NO: 65 (full-length mature FVIII). In another example, a first XTEN is inserted between amino acids 403 and 404 corresponding to SEQ ID NO: 65, and a second XTEN is inserted between amino acids 1720 and 1721 corresponding to SEQ ID NO: 65. In some examples, a first XTEN is inserted between amino acids 1656 and 1657 corresponding to SEQ ID NO: 65, and a second XTEN is inserted between amino acids 1720 and 1721 corresponding to SEQ ID NO: 65. In other examples, a first XTEN is inserted between amino acids 26 and 27 corresponding to SEQ ID NO: 65, a second XTEN is inserted between amino acids 1656 and 1657 corresponding to SEQ ID NO: 65, and a third XTEN is inserted between amino acids 1720 and 1721 corresponding to SEQ ID NO: 65. In yet other embodiments, a first XTEN is inserted between amino acids 403 and 404 corresponding to SEQ ID NO: 65, a second XTEN is inserted between amino acids 1656 and 1657 corresponding to SEQ ID NO: 65, and a third XTEN is inserted between amino acids 1720 and 1721 corresponding to SEQ ID NO: 65. In still other embodiments, a first XTEN is inserted between amino acids 403 and 404 corresponding to SEQ ID NO: 65, a second XTEN is inserted between amino acids 1656 and 1657 corresponding to SEQ ID NO: 65, and a third XTEN is inserted between amino acids 1720 and 1721 corresponding to SEQ ID NO: 65. In certain embodiments, a first XTEN is inserted between amino acids 26 and 27 corresponding to SEQ ID NO: 65, a second XTEN is inserted between amino acids 1720 and 1721 corresponding to SEQ ID NO: 65, and a third XTEN is inserted between amino acids 1900 and 1901 corresponding to SEQ ID NO: 65. In some embodiments, a first XTEN is inserted between amino acids 26 and 27 corresponding to SEQ ID NO: 65, a second XTEN is inserted between amino acids 1656 and 1657 corresponding to SEQ ID NO: 65, a third XTEN is inserted between amino acids 1720 and 1721 corresponding to SEQ ID NO: 65, and a fourth XTEN is inserted between 1900 and 1901 corresponding to SEQ ID NO: 65.

In a particular embodiment, an XTEN sequence is inserted between amino acids 745 and 746 of a full-length Factor VIII or the corresponding insertion site of the B-domain deleted Factor VIII.

In some embodiments, a chimeric protein of the invention comprises two polypeptide sequences, a first polypeptide sequence comprising an amino acid sequence at least about 80%, 90%, 95%, or 100% identical to a sequence selected from FVIII-161 (SEQ ID NO: 69), FVIII-169 (SEQ ID NO: 70), FVIII-170 (SEQ ID NO: 71), FVIII-173 (SEQ ID NO: 72); FVIII-195 (SEQ ID NO: 73); FVIII-196 (SEQ ID NO: 74), FVIII199 (SEQ ID NO: 75), FVIII-201 (SEQ ID NO: 76); FVIII-203 (SEQ ID NO: 77), FVIII-204 (SEQ ID NO: 78), FVIII-205 (SEQ ID NO: 79), FVIII-266 (SEQ ID NO: 80), FVIII-267 (SEQ ID NO: 81), FVIII-268 (SEQ ID NO: 82), FVIII-269 (SEQ ID NO: 83), FVIII-271 (SEQ ID NO: 84) or FVIII-272 (SEQ ID NO: 85) and a second polypeptide sequence comprising an amino acid sequence at least about 80%, 90%, 95%, or 100% identical to a sequence selected from VWF031 (SEQ ID NO: 86), VWF034 (SEQ ID NO: 87), or VWF-036.

II.D. Ig Constant Region or a Portion Thereof

The chimeric protein of the invention also includes two Ig constant region or a portion thereof, a first Ig constant region or a portion thereof fused to a FVIII protein by an optional linker and a second Ig constant region or a portion thereof fused to a VWF protein through the XTEN sequence having less than 288 amino acids. The Ig constant region or a portion thereof can improve pharmacokinetic or pharmacodynamic properties of the chimeric protein in combination with the XTEN sequence and the VWF protein. In certain embodiments, the Ig constant region or a portion thereof extends a half-life of a molecule fused to the Ig constant region or a portion thereof.

An Ig constant region is comprised of domains denoted CH (constant heavy) domains (CH1, CH2, etc.). Depending on the isotype, (i.e. IgG, IgM, IgA, IgD, or IgE), the constant region can be comprised of three or four CH domains. Some isotypes (e.g. IgG) constant regions also contain a hinge region. See Janeway et al. 2001, *Immunobiology*, Garland Publishing, N.Y., N.Y.

An Ig constant region or a portion thereof for producing the chimeric protein of the present invention may be obtained from a number of different sources. In some embodiments, an Ig constant region or a portion thereof is derived from a human Ig. It is understood, however, that the Ig constant region or a portion thereof may be derived from an Ig of another mammalian species, including for example, a rodent (e.g. a mouse, rat, rabbit, guinea pig) or non-human primate (e.g. chimpanzee, macaque) species. Moreover, the Ig constant region or a portion thereof may be derived from any Ig class, including IgM, IgG, IgD, IgA, and IgE, and any Ig isotype, including IgG1, IgG2, IgG3, and IgG4. In one embodiment, the human isotype IgG1 is used.

A variety of the Ig constant region gene sequences (e.g., human constant region gene sequences) are available in the form of publicly accessible deposits. Constant region domains sequence can be selected having a particular effector function (or lacking a particular effector function) or with a particular modification to reduce immunogenicity. Many sequences of antibodies and antibody-encoding genes have been published and suitable Ig constant region sequences (e.g., hinge, CH2, and/or CH3 sequences, or portions thereof) can be derived from these sequences using art recognized techniques. The genetic material obtained using any of the foregoing methods may then be altered or synthesized to obtain polypeptides of the present invention. It will further be appreciated that the scope of this invention encompasses alleles, variants and mutations of constant region DNA sequences.

The sequences of the Ig constant region or a portion thereof can be cloned, e.g., using the polymerase chain reaction and primers which are selected to amplify the domain of interest. To clone a sequence of the Ig constant region or a portion thereof from an antibody, mRNA can be isolated from hybridoma, spleen, or lymph cells, reverse transcribed into DNA, and antibody genes amplified by PCR. PCR amplification methods are described in detail in U.S. Pat. Nos. 4,683,195; 4,683,202; 4,800,159; 4,965,188; and in, e.g., "PCR Protocols: A Guide to Methods and Applications" Innis et al. eds., Academic Press, San Diego, Calif. (1990); Ho et al. 1989. Gene 77:51; Horton et al. 1993. Methods Enzymol. 217:270). PCR may be initiated by consensus constant region primers or by more specific primers based on the published heavy and light chain DNA and amino acid sequences. As discussed above, PCR also may be used to isolate DNA clones encoding the antibody light and heavy chains. In this case the libraries may be screened by consensus primers or larger homologous probes, such as mouse constant region probes. Numerous primer sets suitable for amplification of antibody genes are known in the art (e.g., 5' primers based on the N-terminal sequence of purified antibodies (Benhar and Pastan. 1994. Protein Engineering 7:1509); rapid amplification of cDNA ends (Ruberti, F. et al. 1994. J. Immunol. Methods 173:33); antibody leader sequences (Larrick et al. 1989 Biochem. Biophys. Res. Commun. 160:1250). The cloning of antibody sequences is further described in Newman et al., U.S. Pat. No. 5,658,570, filed Jan. 25, 1995, which is incorporated by reference herein.

An Ig constant region used herein can include all domains and the hinge region or portions thereof. In one embodiment, the Ig constant region or a portion thereof comprises CH2 domain, CH3 domain, and a hinge region, i.e., an Fc region or an FcRn binding partner.

As used herein, the term "Fc region" is defined as the portion of a polypeptide which corresponds to the Fc region of native Ig, i.e., as formed by the dimeric association of the respective Fc domains of its two heavy chains. A native Fc region forms a homodimer with another Fc region. In contrast, the term "genetically-fused Fc region" or "single-chain Fc region" (scFc region), as used herein, refers to a synthetic dimeric Fc region comprised of Fc domains genetically linked within a single polypeptide chain (i.e., encoded in a single contiguous genetic sequence).

In one embodiment, the "Fc region" refers to the portion of a single Ig heavy chain beginning in the hinge region just upstream of the papain cleavage site (i.e. residue 216 in IgG, taking the first residue of heavy chain constant region to be 114) and ending at the C-terminus of the antibody. Accordingly, a complete Fc domain comprises at least a hinge domain, a CH2 domain, and a CH3 domain.

The Fc region of an Ig constant region, depending on the Ig isotype can include the CH2, CH3, and CH4 domains, as well as the hinge region. Chimeric proteins comprising an Fc region of an Ig bestow several desirable properties on a chimeric protein including increased stability, increased serum half-life (see Capon et al., 1989, Nature 337:525) as well as binding to Fc receptors such as the neonatal Fc receptor (FcRn) (U.S. Pat. Nos. 6,086,875, 6,485,726, 6,030,613; WO 03/077834; US2003-0235536A1), which are incorporated herein by reference in their entireties.

An Ig constant region or a portion thereof can be an FcRn binding partner. FcRn is active in adult epithelial tissues and expressed in the lumen of the intestines, pulmonary airways, nasal surfaces, vaginal surfaces, colon and rectal surfaces (U.S. Pat. No. 6,485,726). An FcRn binding partner is a portion of an Ig that binds to FcRn.

The FcRn receptor has been isolated from several mammalian species including humans. The sequences of the human FcRn, monkey FcRn, rat FcRn, and mouse FcRn are known (Story et al. 1994, J. Exp. Med. 180:2377). The FcRn receptor binds IgG (but not other Ig classes such as IgA, IgM, IgD, and IgE) at relatively low pH, actively transports the IgG transcellularly in a luminal to serosal direction, and then releases the IgG at relatively higher pH found in the interstitial fluids. It is expressed in adult epithelial tissue (U.S. Pat. Nos. 6,485,726, 6,030,613, 6,086,875; WO 03/077834; US2003-0235536A1) including lung and intestinal epithelium (Israel et al. 1997, Immunology 92:69) renal proximal tubular epithelium (Kobayashi et al. 2002, Am. J. Physiol. Renal Physiol. 282:F358) as well as nasal epithelium, vaginal surfaces, and biliary tree surfaces.

FcRn binding partners useful in the present invention encompass molecules that can be specifically bound by the FcRn receptor including whole IgG, the Fc fragment of IgG, and other fragments that include the complete binding region of the FcRn receptor. The region of the Fc portion of IgG that binds to the FcRn receptor has been described based on X-ray crystallography (Burmeister et al. 1994, Nature 372:379). The major contact area of the Fc with the FcRn is near the junction of the CH2 and CH3 domains. Fc-FcRn contacts are all within a single Ig heavy chain. The FcRn binding partners include whole IgG, the Fc fragment of IgG, and other fragments of IgG that include the complete binding region of FcRn. The major contact sites include amino acid residues 248, 250-257, 272, 285, 288, 290-291, 308-311, and 314 of the CH2 domain and amino acid residues 385-387, 428, and 433-436 of the CH3 domain. References made to amino acid numbering of Igs or Ig fragments, or regions, are all based on Kabat et al. 1991, Sequences of Proteins of Immunological Interest, U.S. Department of Public Health, Bethesda, Md.

Fc regions or FcRn binding partners bound to FcRn can be effectively shuttled across epithelial barriers by FcRn, thus providing a non-invasive means to systemically administer a desired therapeutic molecule. Additionally, fusion proteins comprising an Fc region or an FcRn binding partner are endocytosed by cells expressing the FcRn. But instead of being marked for degradation, these fusion proteins are recycled out into circulation again, thus increasing the in vivo half-life of these proteins. In certain embodiments, the portions of Ig constant regions are an Fc region or an FcRn binding partner that typically associates, via disulfide bonds and other non-specific interactions, with another Fc region or another FcRn binding partner to form dimers and higher order multimers.

Two FcRn receptors can bind a single Fc molecule. Crystallographic data suggest that each FcRn molecule binds a single polypeptide of the Fc homodimer. In one embodiment, linking the FcRn binding partner, e.g., an Fc fragment of an IgG, to a biologically active molecule provides a means of delivering the biologically active molecule orally, buccally, sublingually, rectally, vaginally, as an aerosol administered nasally or via a pulmonary route, or via an ocular route. In another embodiment, the chimeric protein can be administered invasively, e.g., subcutaneously, intravenously.

An FcRn binding partner region is a molecule or a portion thereof that can be specifically bound by the FcRn receptor with consequent active transport by the FcRn receptor of the Fc region. Specifically bound refers to two molecules forming a complex that is relatively stable under physiologic conditions. Specific binding is characterized by a high affinity and a low to moderate capacity as distinguished from nonspecific binding which usually has a low affinity with a moderate to high capacity. Typically, binding is considered specific when the affinity constant KA is higher than $10^6$ $M^{-1}$, or higher than $10^8$ $M^{-1}$. If necessary, non-specific binding can be reduced without substantially affecting specific binding by varying the binding conditions. The appropriate binding conditions such as concentration of the molecules, ionic strength of the solution, temperature, time allowed for binding, concentration of a blocking agent (e.g. serum albumin, milk casein), etc., may be optimized by a skilled artisan using routine techniques.

In certain embodiments, a chimeric protein of the invention comprises one or more truncated Fc regions that are nonetheless sufficient to confer Fc receptor (FcR) binding properties to the Fc region. For example, the portion of an Fc region that binds to FcRn (i.e., the FcRn binding portion) comprises from about amino acids 282-438 of IgG1, EU numbering (with the primary contact sites being amino acids 248, 250-257, 272, 285, 288, 290-291, 308-311, and 314 of the CH2 domain and amino acid residues 385-387, 428, and 433-436 of the CH3 domain. Thus, an Fc region of the invention may comprise or consist of an FcRn binding portion. FcRn binding portions may be derived from heavy chains of any isotype, including IgG1, IgG2, IgG3 and IgG4. In one embodiment, an FcRn binding portion from an antibody of the human isotype IgG1 is used. In another embodiment, an FcRn binding portion from an antibody of the human isotype IgG4 is used.

In another embodiment, the "Fc region" includes an amino acid sequence of an Fc domain or derived from an Fc domain. In certain embodiments, an Fc region comprises at least one of: a hinge (e.g., upper, middle, and/or lower hinge region) domain (about amino acids 216-230 of an antibody Fc region according to EU numbering), a CH2 domain (about amino acids 231-340 of an antibody Fc region according to EU numbering), a CH3 domain (about amino acids 341-438 of an antibody Fc region according to EU numbering), a CH4 domain, or a variant, portion, or fragment thereof. In other embodiments, an Fc region comprises a complete Fc domain (i.e., a hinge domain, a CH2 domain, and a CH3 domain). In some embodiments, an Fc region comprises, consists essentially of, or consists of a hinge domain (or a portion thereof) fused to a CH3 domain (or a portion thereof), a hinge domain (or a portion thereof) fused to a CH2 domain (or a portion thereof), a CH2 domain (or a portion thereof) fused to a CH3 domain (or a portion thereof), a CH2 domain (or a portion thereof) fused to both a hinge domain (or a portion thereof) and a CH3 domain (or a portion thereof). In still other embodiments, an Fc region lacks at least a portion of a CH2 domain (e.g., all or part of a CH2 domain). In a particular embodiment, an Fc region comprises or consists of amino acids corresponding to EU numbers 221 to 447.

The Fc regions denoted as F, F1, or F2 herein may be obtained from a number of different sources. In one embodiment, an Fc region of the polypeptide is derived from a human Ig. It is understood, however, that an Fc region may be derived from an Ig of another mammalian species, including for example, a rodent (e.g. a mouse, rat, rabbit, or guinea pig) or non-human primate (e.g. chimpanzee, macaque) species. Moreover, the polypeptide of the Fc domains or portions thereof may be derived from any Ig class, including IgM, IgG, IgD, IgA and IgE, and any Ig isotype, including IgG1, IgG2, IgG3 and IgG4. In another embodiment, the human isotype IgG1 is used.

In certain embodiments, the Fc variant confers a change in at least one effector function imparted by an Fc region comprising said wild-type Fc domain (e.g., an improvement or reduction in the ability of the Fc region to bind to Fc receptors (e.g. FcγRI, FcγRII, or FcγRIII) or complement proteins (e.g. C1q), or to trigger antibody-dependent cytotoxicity (ADCC), phagocytosis, or complement-dependent cytotoxicity (CDCC)). In other embodiments, the Fc variant provides an engineered cysteine residue.

The Fc regions of the invention may employ art-recognized Fc variants which are known to impart a change (e.g., an enhancement or reduction) in effector function and/or FcR or FcRn binding. Specifically, a binding molecule of the invention may include, for example, a change (e.g., a substitution) at one or more of the amino acid positions disclosed in International PCT Publications WO88/07089A1, WO96/14339A1, WO98/05787A1, WO98/23289A1, WO99/51642A1, WO99/58572A1, WO00/09560A2, WO00/32767A1, WO00/42072A2, WO02/44215A2, WO02/060919A2, WO03/074569A2, WO04/016750A2, WO04/029207A2, WO04/035752A2, WO04/063351A2, WO04/074455A2, WO04/099249A2, WO05/040217A2, WO04/044859, WO05/070963A1, WO05/077981A2, WO05/092925A2, WO05/123780A2, WO06/019447A1, WO06/047350A2, and WO06/085967A2; US Patent Publication Nos. US2007/0231329, US2007/0231329, US2007/0237765, US2007/0237766, US2007/0237767, US2007/0243188, US20070248603, US20070286859, US20080057056; or U.S. Pat. Nos. 5,648,260; 5,739,277; 5,834,250; 5,869,046; 6,096,871; 6,121,022; 6,194,551; 6,242,195; 6,277,375; 6,528,624; 6,538,124; 6,737,056; 6,821,505; 6,998,253; 7,083,784; 7,404,956, and 7,317,091, each of which is incorporated by reference herein. In one embodiment, the specific change (e.g., the specific substitution of one or more amino acids disclosed in the art) may be made at one or more of the disclosed amino acid positions. In another embodiment, a different change at one or more of the disclosed amino acid positions (e.g., the different substitution of one or more amino acid position disclosed in the art) may be made.

The Fc region or FcRn binding partner of IgG can be modified according to well recognized procedures such as site directed mutagenesis and the like to yield modified IgG or Fc fragments or portions thereof that will be bound by FcRn. Such modifications include modifications remote from the FcRn contact sites as well as modifications within the contact sites that preserve or even enhance binding to the FcRn. For example, the following single amino acid residues in human IgG1 Fc (Fc γ1) can be substituted without significant loss of Fc binding affinity for FcRn: P238A, S239A, K246A, K248A, D249A, M252A, T256A, E258A, T260A, D265A, S267A, H268A, E269A, D270A, E272A, L274A, N276A, Y278A, D280A, V282A, E283A, H285A, N286A, T289A, K290A, R292A, E293A, E294A, Q295A, Y296F, N297A, S298A, Y300F, R301A, V303A, V305A, T307A, L309A, Q311A, D312A, N315A, K317A, E318A, K320A, K322A, S324A, K326A, A327Q, P329A, A330Q, P331A, E333A, K334A, T335A, S337A, K338A, K340A, Q342A, R344A, E345A, Q347A, R355A, E356A, M358A, T359A, K360A, N361A, Q362A, Y373A, S375A, D376A, A378Q, E380A, E382A, S383A, N384A, Q386A, E388A, N389A, N390A, Y391F, K392A, L398A, S400A, D401A, D413A, K414A, R416A, Q418A, Q419A, N421A, V422A, S424A, E430A, N434A, T437A, Q438A, K439A, S440A, S444A, and K447A, where for example P238A represents wild type proline substituted by alanine at position number 238. As an example, a specific embodiment incorporates the N297A mutation, removing a highly conserved N-glycosylation site. In addition to alanine other amino acids may be substituted for the wild type amino acids at the positions specified above. Mutations may be introduced singly into Fc giving rise to more than one hundred Fc regions distinct from the native Fc. Additionally, combinations of two, three, or more of these individual mutations may be introduced together, giving rise to hundreds more Fc regions. Moreover, one of the Fc region of a construct of the invention may be mutated and the other Fc region of the construct not mutated at all, or they both may be mutated but with different mutations.

Certain of the above mutations may confer new functionality upon the Fc region or FcRn binding partner. For example, one embodiment incorporates N297A, removing a highly conserved N-glycosylation site. The effect of this mutation is to reduce immunogenicity, thereby enhancing circulating half-life of the Fc region, and to render the Fc region incapable of binding to FcγRI, FcγRIIA, FcγRIIB, and FcγRIIIA, without compromising affinity for FcRn (Routledge et al. 1995, Transplantation 60:847; Friend et al. 1999, Transplantation 68:1632; Shields et al. 1995, J. Biol. Chem. 276:6591). As a further example of new functionality arising from mutations described above affinity for FcRn may be increased beyond that of wild type in some instances. This increased affinity may reflect an increased "on" rate, a decreased "off" rate or both an increased "on" rate and a decreased "off" rate. Examples of mutations believed to impart an increased affinity for FcRn include, but not limited to, T256A, T307A, E380A, and N434A (Shields et al. 2001, J. Biol. Chem. 276:6591).

Additionally, at least three human Fc gamma receptors appear to recognize a binding site on IgG within the lower hinge region, generally amino acids 234-237. Therefore, another example of new functionality and potential decreased immunogenicity may arise from mutations of this region, as for example by replacing amino acids 233-236 of human IgG1 "ELLG" to the corresponding sequence from IgG2 "PVA" (with one amino acid deletion). It has been shown that FcγRI, FcγRII, and FcγRIII, which mediate various effector functions will not bind to IgG1 when such mutations have been introduced. Ward and Ghetie 1995, Therapeutic Immunology 2:77 and Armour et al. 1999, Eur. J. Immunol 29:2613.

In one embodiment, the Ig constant region or a portion thereof, e.g., an Fc region, is a polypeptide including the sequence (SEQ ID NO: 89 or SEQ ID NO: 3 of U.S. Pat. No. 5,739,277) and optionally further including a sequence selected from HQSLGTQ (SEQ ID NO: 90), HQNLSDGK (SEQ ID NO: 91), HQNISDGK (SEQ ID NO: 92), or VISSHLGQ (SEQ ID NO: 93) (or SEQ ID NOs: 11, 1, 2, and 31, respectively of U.S. Pat. No. 5,739,277).

In another embodiment, the immunoglobulin constant region or a portion thereof comprises an amino acid sequence in the hinge region or a portion thereof that forms one or more disulfide bonds with another immunoglobulin constant region or a portion thereof. The disulfide bond by the immunoglobulin constant region or a portion thereof places the first polypeptide comprising FVIII and the second polypeptide comprising the VWF fragment together so that endogenous VWF does not replace the VWF fragment and does not bind to the FVIII. Therefore, the disulfide bond between the first immunoglobulin constant region or a portion thereof and a second immunoglobulin constant region or a portion thereof prevents interaction between endogenous VWF and the FVIII protein. This inhibition of interaction between the VWF and the FVIII protein allows the half-life of the chimeric protein to go beyond the two fold limit. The hinge region or a portion thereof can further be linked to one or more domains of CH1, CH2, CH3, a fragment thereof, and any combinations thereof. In a particular embodiment, the immunoglobulin constant region or a portion thereof is a hinge region and CH2.

In certain embodiments, the Ig constant region or a portion thereof is hemi-glycosylated. For example, the chimeric protein comprising two Fc regions or FcRn binding partners may contain a first, glycosylated, Fc region (e.g., a glycosylated CH2 region) or FcRn binding partner and a second, aglycosylated, Fc region (e.g., an aglycosylated CH2 region) or FcRn binding partner. In one embodiment, a linker may be interposed between the glycosylated and aglycosylated Fc regions. In another embodiment, the Fc region or FcRn binding partner is fully glycosylated, i.e., all of the Fc regions are glycosylated. In other embodiments, the Fc region may be aglycosylated, i.e., none of the Fc moieties are glycosylated.

In certain embodiments, a chimeric protein of the invention comprises an amino acid substitution to an Ig constant region or a portion thereof (e.g., Fc variants), which alters the antigen-independent effector functions of the Ig constant region, in particular the circulating half-life of the protein.

Such proteins exhibit either increased or decreased binding to FcRn when compared to proteins lacking these substitutions and, therefore, have an increased or decreased half-life in serum, respectively. Fc variants with improved affinity for FcRn are anticipated to have longer serum half-lives, and such molecules have useful applications in methods of treating mammals where long half-life of the administered polypeptide is desired, e.g., to treat a chronic disease or disorder (see, e.g., U.S. Pat. Nos. 7,348,004, 7,404,956, and 7,862,820). In contrast, Fc variants with decreased FcRn binding affinity are expected to have shorter half-lives, and such molecules are also useful, for example, for administration to a mammal where a shortened circulation time may be advantageous, e.g. for in vivo diagnostic imaging or in situations where the starting polypeptide has toxic side effects when present in the circulation for prolonged periods. Fc variants with decreased FcRn binding affinity are also less likely to cross the placenta and, thus, are also useful in the treatment of diseases or disorders in pregnant women. In addition, other applications in which reduced FcRn binding affinity may be desired include those applications in which localization the brain, kidney, and/or liver is desired. In one exemplary embodiment, the chimeric protein of the invention exhibit reduced transport across the epithelium of kidney glomeruli from the vasculature. In another embodiment, the chimeric protein of the invention exhibit reduced transport across the blood brain barrier (BBB) from the brain, into the vascular space. In one embodiment, a protein with altered FcRn binding comprises at least one Fc region or FcRn binding partner (e.g., one or two Fc regions or FcRn binding partners) having one or more amino acid substitutions within the "FcRn binding loop" of an Ig constant region. The FcRn binding loop is comprised of amino acid residues 280-299 (according to EU numbering) of a wild-type, full-length, Fc region. In other embodiments, an Ig constant region or a portion thereof in a chimeric protein of the invention having altered FcRn binding affinity comprises at least one Fc region or FcRn binding partner having one or more amino acid substitutions within the 15 Å FcRn "contact zone." As used herein, the term 15 Å FcRn "contact zone" includes residues at the following positions of a wild-type, full-length Fc moiety: 243-261, 275-280, 282-293, 302-319, 336-348, 367, 369, 372-389, 391, 393, 408, 424, 425-440 (EU numbering). In other embodiments, a Ig constant region or a portion thereof of the invention having altered FcRn binding affinity comprises at least one Fc region or FcRn binding partner having one or more amino acid substitutions at an amino acid position corresponding to any one of the following EU positions: 256, 277-281, 283-288, 303-309, 313, 338, 342, 376, 381, 384, 385, 387, 434 (e.g., N434A or N434K), and 438. Exemplary amino acid substitutions which altered FcRn binding activity are disclosed in International PCT Publication No. WO05/047327 which is incorporated by reference herein.

An Fc region or FcRn binding partner used in the invention may also comprise an art recognized amino acid substitution which alters the glycosylation of the chimeric protein. For example, the Fc region or FcRn binding partner of the chimeric protein linked to a VWF fragment or a FVIII protein may comprise an Fc region having a mutation leading to reduced glycosylation (e.g., N- or O-linked glycosylation) or may comprise an altered glycoform of the wild-type Fc moiety (e.g., a low fucose or fucose-free glycan).

In one embodiment, an unprocessed chimeric protein of the invention may comprise a genetically fused Fc region (i.e., scFc region) having two or more of its constituent Ig constant region or a portion thereof independently selected from the Ig constant region or a portion thereof described herein. In one embodiment, the Fc regions of a dimeric Fc region are the same. In another embodiment, at least two of the Fc regions are different. For example, the Fc regions or FcRn binding partners of the proteins of the invention comprise the same number of amino acid residues or they may differ in length by one or more amino acid residues (e.g., by about 5 amino acid residues (e.g., 1, 2, 3, 4, or 5 amino acid residues), about 10 residues, about 15 residues, about 20 residues, about 30 residues, about 40 residues, or about 50 residues). In yet other embodiments, the Fc regions or FcRn binding partners of the protein of the invention may differ in sequence at one or more amino acid positions. For example, at least two of the Fc regions or FcRn binding partners may differ at about 5 amino acid positions (e.g., 1, 2, 3, 4, or 5 amino acid positions), about 10 positions, about 15 positions, about 20 positions, about 30 positions, about 40 positions, or about 50 positions).

II.E. Linkers

The chimeric protein of the present invention further comprises one or more linkers. One type of the linkers is a cleavable linker, which can be cleaved by various proteases when administered to a subject in vivo, e.g., at a site of coagulation. In one embodiment, the cleavable linker allows cleavage of moiety, e.g., a VWF protein, from the XTEN sequence, thus from the chimeric protein at the site of the coagulation cascade, thereby allowing activated FVIII (FVIIIa) to have its FVIIIa activity. Another type of the linkers is a processable linker, which contains an intracellular cleavage site and thus can be cleaved by an intracellular processing enzyme in a host cell, allowing convenient expression of a polypeptide and formation of a chimeric protein.

One or more linkers can be present between any two proteins in the chimeric protein. In one embodiment, a chimeric protein comprises a first polypeptide which comprises (i) a FVIII protein and (ii) a first Ig constant region or a portion thereof and a second polypeptide which comprises (iii) a VWF protein, (iv) a linker (e.g., a cleavable linker), (v) an XTEN sequence, and (vi) a second Ig constant region or a portion thereof. In another embodiment, a chimeric protein comprises a first polypeptide which comprises (i) a FVIII protein and (ii) a first Ig constant region or a portion thereof and a second polypeptide which comprises (iii) a VWF protein, (iv) an XTEN sequence, (v) a linker (e.g., a cleavable linker), and (vi) a second Ig constant region or a portion thereof. In other embodiments, a chimeric protein comprises a first polypeptide which comprises (i) a FVIII protein and (ii) a first Ig constant region or a portion thereof and a second polypeptide which comprises (iii) a VWF protein, (iv) a first linker (e.g., a cleavable linker), (v) an XTEN sequence, (vi) a second linker (e.g., a cleavable linker), and (vii) a second Ig constant region or a portion thereof. In some embodiments, the first polypeptide further comprises a linker, e.g., a cleavable linker between the FVIII protein and the first Ig constant region.

In certain embodiments, a chimeric protein comprises a single chain comprising (i) a FVIII protein, (ii) a first Ig constant region or a portion thereof, (iii) a linker (e.g., a processable linker), (iv) a VWF protein, (v) an XTEN sequence, and (vi) a second Ig constant region or a portion thereof. In other embodiments, a chimeric protein comprises a single chain comprising (i) a FVIII protein, (ii) a first Ig constant region or a portion thereof, (iii) a first linker (e.g., a processable linker), (iv) a VWF protein, (v) a second linker (e.g., a cleavable linker), (vi) an XTEN sequence, and (vii) a second Ig constant region or a portion thereof. The processable linker can be processed after the chimeric protein is expressed in the host cell; thus the chimeric protein produced in the host cell can be in the final form comprising two or three polypeptide chains.

The linker useful in the present invention can comprise any organic molecule. In one embodiment, the linker comprises a polymer, e.g., polyethylene glycol (PEG) or hydroxyethyl starch (HES). In another embodiment, the linker comprises an amino acids sequence. The linker can comprise at least about 10, 20, 30, 40, 50, 60, 70, 80, 90, 100, 150, 200, 300, 400, 500, 600, 700, 800, 900, 1000, 1100, 1200, 1300, 1400, 1500, 1600, 1700, 1800, 1900, or 2000 amino acids. The linker can comprise 1-5 amino acids, 1-10 amino acids, 1-20 amino acids, 10-50 amino acids, 50-100 amino acids, 100-200 amino acids, 200-300 amino acids, 300-400 amino acids, 400-500 amino acids, 500-600 amino acids, 600-700 amino acids, 700-800 amino acids, 800-900 amino acids, or 900-1000 amino acids. In one embodiment, the linker comprises an XTEN sequence. Additional examples of XTEN can be used according to the present invention and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, or WO 2011028344 A2. In another embodiment, the linker is a PAS sequence.

In one embodiment, the linker is a polymer, e.g., polyethylene glycol (PEG) or hydroxyethyl starch (HES). In another embodiment, the linker is an amino acid sequence. The linker can comprise at least about 10, 20, 30, 40, 50, 60, 70, 80, 90, 100, 150, 200, 300, 400, 500, 600, 700, 800, 900, 1000, 1100, 1200, 1300, 1400, 1500, 1600, 1700, 1800, 1900, or 2000 amino acids. The linker can comprise 1-5 amino acids, 1-10 amino acids, 1-20 amino acids, 10-50 amino acids, 50-100 amino acids, 100-200 amino acids, 200-300 amino acids, 300-400 amino acids, 400-500 amino acids, 500-600 amino acids, 600-700 amino acids, 700-800 amino acids, 800-900 amino acids, or 900-1000 amino acids.

Examples of linkers are well known in the art. In one embodiment, the linker comprises the sequence G. The linker can comprise the sequence $(GA)_n$. The linker can comprise the sequence $(GGS)_n$. In other embodiments, the linker comprises $(GGGS)_n$ (SEQ ID NO: 101). In still other embodiments, the linker comprises the sequence $(GGS)_n$ $(GGGGS)_n$ (SEQ ID NO: 95). In these instances, n may be an integer from 1-100. In other instances, n may be an integer from 1-20, i.e., 1, 2, 3, 4, 5, 6, 7, 8, 9, 10, 11, 12, 13, 14, 15, 16, 17, 18, 19, or 20. Examples of linkers include, but are not limited to, GGG, SGGSGGS (SEQ ID NO: 96), GGSGGSGGSGGSGGG (SEQ ID NO: 97), GGSGGSGGGGSGGGS (SEQ ID NO: 98), GGSGGSGGSGGSGGSGGS (SEQ ID NO: 99), or GGGGSGGGGSGGGGS (SEQ ID NO: 100). The linker does not eliminate or diminish the VWF protein activity or the clotting activity of Factor VIII. Optionally, the linker enhances the VWF protein activity or the clotting activity of Factor VIII protein, e.g., by further diminishing the effects of steric hindrance and making the VWF protein or Factor VIII portion more accessible to its target binding site.

In one embodiment, the linker useful for the chimeric protein is 15-25 amino acids long. In another embodiment, the linker useful for the chimeric protein is 15-20 amino acids long. In some embodiments, the linker for the chimeric protein is 10-25 amino acids long. In other embodiments, the linker for the chimeric protein is 15 amino acids long. In still other embodiments, the linker for the chimeric protein is $(GGGGS)_n$ (SEQ ID NO: 94) where G represents glycine, S represents serine and n is an integer from 1-20.

II. F. Cleavage Sites

A cleavable linkers can incorporate a moiety capable of being cleaved either chemically (e.g., hydrolysis of an ester bond), enzymatically (i.e., incorporation of a protease cleavage sequence), or photolytically (e.g., a chromophore such as 3-amino-3-(2-nitrophenyl) proprionic acid (ANP)) in order to release one molecule from another.

In one embodiment, a cleavable linker comprises one or more cleavage sites at the N-terminus or C-terminus or both. In another embodiment, the cleavable linker consists essentially of or consists of one or more cleavable sites. In other embodiments, the cleavable linker comprises heterologous amino acid linker sequences described herein or polymers and one or more cleavable sites.

In certain embodiments, a cleavable linker comprises one or more cleavage sites that can be cleaved in a host cell (i.e., intracellular processing sites). Non limiting examples of the cleavage site include RRRR (SEQ ID NO: 102), RKRRKR (SEQ ID NO: 103), and RRRRS (SEQ ID NO: 104).

In some embodiments, a cleavable linker comprises an a1 region from FVIII, an a2 region from FVIII, an a3 region from FVIII, a thrombin cleavable site which comprises X—V-P-R (SEQ ID NO: 105) and a PAR1 exosite interaction motif, wherein X is an aliphatic amino acid, or any combinations thereof. comprises the a2 region which comprises an amino acid sequence at least about 80%, about 85%, about 90%, about 95%, or 100% identical to Glu720 to Arg740 corresponding to full-length FVIII, wherein the a2 region is capable of being cleaved by thrombin. In a particular embodiment, a cleavable linker useful for the invention comprises an a2 region which comprises ISDKNTGDYYEDSYEDISAYLLSKNNAIEPRSFS (SEQ ID NO: 106). In other embodiments, a cleavable linker for the invention comprises the a1 region which comprises an amino acid sequence at least about 80%, about 85%, about 90%, about 95%, or 100% identical to Met337 to Arg372 corresponding to full-length FVIII, wherein the a1 region is capable of being cleaved by thrombin. In a particular embodiment, the a1 region comprises ISMKNNEEAEDYDDDLTDSEMDVVRFDDDNSPSFIQIRSV (SEQ ID NO: 107). In some embodiments, a cleavable linker of the invention comprises the a3 region which comprises an amino acid sequence at least about 80%, about 85%, about 90%, about 95%, or 100% identical to Glu1649 to Arg1689 corresponding to full-length FVIII, wherein the a3 region is capable of being cleaved by thrombin. In a specific embodiment, a cleavable linker for the invention comprises an a3 region comprises ISEITRTTLQSDQEEIDYDDTISVEMKKEDFDIYDEDENQSPRSFQ (SEQ ID NO: 108).

In other embodiments, a cleavable linker comprises the thrombin cleavage site which comprises X-V-P-R (SEQ ID NO: 105) and the PAR1 exosite interaction motif and wherein the PAR1 exosite interaction motif comprises S-F-L-L-R-N (SEQ ID NO: 109). The PAR1 exosite interaction motif can further comprise an amino acid sequence selected from P, P-N, P-N-D, P-N-D-K (SEQ ID NO: 110), P-N-D-K-Y (SEQ ID NO: 111), P-N-D-K-Y-E (SEQ ID NO: 112), P-N-D-K-Y-E-P (SEQ ID NO: 113), P-N-D-K-Y-E-P-F (SEQ ID NO: 114), P-N-D-K-Y-E-P-F-W (SEQ ID NO: 115), P-N-D-K-Y-E-P-F-W-E (SEQ ID NO: 116), P-N-D-K-Y-E-P-F-W-E-D (SEQ ID NO: 117), P-N-D-K-Y-E-P-F-W-E-D-E (SEQ ID NO: 118), P-N-D-K-Y-E-P-F-W-E-D-E-E (SEQ ID NO: 119), P-N-D-K-Y-E-P-F-W-E-D-E-E-S (SEQ ID NO: 120), or any combination thereof. In some embodiments, the aliphatic amino acid is selected from Glycine, Alanine, Valine, Leucine, or Isoleucine.

In other embodiments, a cleavable linker comprises one or more cleavage sites that are cleaved by a protease after a chimeric protein comprising the cleavable linker is administered to a subject. In one embodiment, the cleavage site is cleaved by a protease selected from the group consisting of factor XIa, factor XIIa, kallikrein, factor VIIa, factor IXa, factor Xa, factor IIa (thrombin), Elastase-2, MMP-12, MMP-13, MMP-17, and MMP-20. In another embodiment, the cleavage site is selected from the group consisting of a FXIa cleavage site (e.g., KLTR↓AET (SEQ ID NO: 121)), a FXIa cleavage site (e.g., DFTR↓VVG (SEQ ID NO: 122)), a FXIIa cleavage site (e.g., TMTR↓IVGG (SEQ ID NO:

123)), a Kallikrein cleavage site (e.g., SPFR↓STGG (SEQ ID NO: 124)), a FVIIa cleavage site (e.g., LQVR↓IVGG (SEQ ID NO: 125)), a FIXa cleavage site (e.g., PLGR↓IVGG (SEQ ID NO: 126)), a FXa cleavage site (e.g., IEGR↓TVGG (SEQ ID NO: 127)), a FIIa (thrombin) cleavage site (e.g., LTPR↓SLLV (SEQ ID NO: 128)), a Elastase-2 cleavage site (e.g., LGPV↓SGVP (SEQ ID NO: 129)), a Granzyme-B cleavage (e.g., VAGD↓SLEE (SEQ ID NO: 130)), a MMP-12 cleavage site (e.g., GPAG↓LGGA (SEQ ID NO: 131)), a MMP-13 cleavage site (e.g., GPAG↓LRGA (SEQ ID NO: 132)), a MMP-17 cleavage site (e.g., APLG↓LRLR (SEQ ID NO: 133)), a MMP-20 cleavage site (e.g., PALP↓LVAQ (SEQ ID NO: 134)), a TEV cleavage site (e.g., ENLYFQ↓G (SEQ ID NO: 135)), a Enterokinase cleavage site (e.g., DDDK↓IVGG (SEQ ID NO: 136)), a Protease 3C (PRESCISSION™) cleavage site (e.g., LEVLFQ↓IVGP (SEQ ID NO: 137)), and a Sortase A cleavage site (e.g., LPKT↓GSES) (SEQ ID NO: 138). In certain embodiments, the FXIa cleavage sites include, but are not limited to, e.g., TQSFNDFTR (SEQ ID NO: 1) and SVSQTSKLTR (SEQ ID NO: 3). Non-limiting exemplary thrombin cleavage sites include, e.g., DFLAEGGGVR (SEQ ID NO: 4), TTKIKPR (SEQ ID NO: 5), LVPRG (SEQ ID NO: 6), DKNTGDYYEDSYEDISAYLLSKN-NAIEPRSFS (SEQ ID NO: 88), or IEPRSFS (SEQ ID NO: 194), and a sequence comprising, consisting essentially of, or consisting of ALRPR (SEQ ID NO: 7) (e.g., ALR-PRVVGGA (SEQ ID NO: 145)).

In a specific embodiment, the cleavage site is TLDPRSFLLRNPNDKYEPFWEDEEK (SEQ ID NO: 146). In another embodiment, the cleavage site comprises DKNTGDYYEDSYEDISAYLLSKNNAIEPRSFS (SEQ ID NO: 88) or a fragment thereof. In one particular embodiment, the cleavage site comprises IEPRSFS (SEQ ID NO: 194). In another embodiment, the cleavage site comprises EPRSFS (SEQ ID NO: 195), wherein the cleavage site is not the full-length a2 region of FVIII. In still another embodiment, the cleavage site comprises IEPR (SEQ ID NO: 200). In another embodiment, the cleavage site comprises IEPR (SEQ ID NO: 200), wherein the cleavage site is not the full-length a2 region of FVIII or does not comprise the full-length a2 region of FVIII. In other embodiments, the cleavage site comprises DKNTGDYYEDSYEDISAYLL-SKNNAIEPRSFS (SEQ ID NO: 88), KNTGDYYEDSYE-DISAYLLSKNNAIEPRSFS (SEQ ID NO: 139), NTGDYYEDSYEDISAYLLSKNNAIEPRSFS (SEQ ID NO: 140), TGDYYEDSYEDISAYLLSKNNAIEPRSFS (SEQ ID NO: 141), GDYYEDSYEDISAYLLSKN-NAIEPRSFS (SEQ ID NO: 142), DYYEDSYEDISAYLL-SKNNAIEPRSFS (SEQ ID NO: 143), YYEDSYEDISAY-LLSKNNAIEPRSFS (SEQ ID NO: 144), YEDSYEDISAYLLSKNNAIEPRSFS (SEQ ID NO: 176), EDSYEDISAYLLSKNNAIEPRSFS (SEQ ID NO: 177), DSYEDISAYLLSKNNAIEPRSFS (SEQ ID NO: 178), SYEDISAYLLSKNNAIEPRSFS (SEQ ID NO: 179), YEDISAYLLSKNNAIEPRSFS (SEQ ID NO: 180), EDIS-AYLLSKNNAIEPRSFS (SEQ ID NO: 181), DISAYLL-SKNNAIEPRSFS (SEQ ID NO: 182), ISAYLLSKN-NAIEPRSFS (SEQ ID NO: 183), SAYLLSKNNAIEPRSFS (SEQ ID NO: 184), AYLLSKNNAIEPRSFS (SEQ ID NO: 185), YLLSKNNAIEPRSFS (SEQ ID NO: 186), LLSKN-NAIEPRSFS (SEQ ID NO: 187), LSKNNAIEPRSFS (SEQ ID NO: 188), SKNNAIEPRSFS (SEQ ID NO: 189), KNNAIEPRSFS (SEQ ID NO: 190), NNAIEPRSFS (SEQ ID NO: 191), NAIEPRSFS (SEQ ID NO: 192), AIEPRSFS (SEQ ID NO: 193), or IEPRSFS (SEQ ID NO: 194). In other embodiments, the cleavage site comprises DKNTGDYYEDSYEDISAYLLSKNNAIEPRSFS (SEQ ID NO: 88), KNTGDYYEDSYEDISAYLLSKN-NAIEPRSFS (SEQ ID NO: 139), NTGDYYEDSYEDIS-AYLLSKNNAIEPRSFS (SEQ ID NO: 140), TGDYYED-SYEDISAYLLSKNNAIEPRSFS (SEQ ID NO: 141), GDYYEDSYEDISAYLLSKNNAIEPRSFS (SEQ ID NO: 142), DYYEDSYEDISAYLLSKNNAIEPRSFS (SEQ ID NO: 143), YYEDSYEDISAYLLSKNNAIEPRSFS (SEQ ID NO: 144), YEDSYEDISAYLLSKNNAIEPRSFS (SEQ ID NO: 176), EDSYEDISAYLLSKNNAIEPRSFS (SEQ ID NO: 177), DSYEDISAYLLSKNNAIEPRSFS (SEQ ID NO: 178), SYEDISAYLLSKNNAIEPRSFS (SEQ ID NO: 179), YEDISAYLLSKNNAIEPRSFS (SEQ ID NO: 180), EDIS-AYLLSKNNAIEPRSFS (SEQ ID NO: 181), DISAYLL-SKNNAIEPRSFS (SEQ ID NO: 182), ISAYLLSKN-NAIEPRSFS (SEQ ID NO: 183), SAYLLSKNNAIEPRSFS (SEQ ID NO: 184), AYLLSKNNAIEPRSFS (SEQ ID NO: 185), YLLSKNNAIEPRSFS (SEQ ID NO: 186), LLSKN-NAIEPRSFS (SEQ ID NO: 187), LSKNNAIEPRSFS (SEQ ID NO: 188), SKNNAIEPRSFS (SEQ ID NO: 189), KNNAIEPRSFS (SEQ ID NO: 190), NNAIEPRSFS (SEQ ID NO: 191), NAIEPRSFS (SEQ ID NO: 192), AIEPRSFS (SEQ ID NO: 193), or IEPRSFS (SEQ ID NO:194), wherein the cleavage site is not the full-length FVIII a2 region. In certain embodiments the cleavable linker is cleavable in a thrombin cleavage assay as provided herein or as known in the art.

III. Polynucleotides, Vectors, and Host Cells

Also provided in the invention is a polynucleotide encoding a chimeric protein of the invention. In one embodiment, the first polypeptide chain and the second polypeptide chain can be encoded by a single polynucleotide chain. In another embodiment, the first polypeptide chain and the second polypeptide chain are encoded by two different polynucleotides, i.e., a first nucleotide sequence and a second nucleotide sequence. In another embodiment, the first nucleotide sequence and the second nucleotide sequence are on two different polynucleotides (e.g., different vectors).

The invention includes a polynucleotide encoding a single polypeptide chain (e.g., FVIII(X2)-F1-L3-F2-L2-X1-L1-V), wherein FVIII(X2) comprises a FVIII protein in which an XTEN sequence is inserted at one or more insertion sites, F1 comprises a first Ig constant region or a portion thereof, e.g., a first Fc region, L1 comprises a first linker, V comprises a VWF protein, X1 comprises an XTEN sequence having less than 288 amino acids in length, L2 comprises a second linker, L3 comprises a third linker, and F2 comprises a second Ig constant region or a portion thereof, e.g., a second Fc region. The invention also includes two polynucleotides, a first polynucleotide sequence encoding a first polypeptide which comprises a FVIII protein fused to a first Ig constant region or a portion thereof and a second polynucleotide sequence encoding a second polypeptide which comprises a VWF protein, an XTEN sequence having less than 288 amino acids in length, and a second Ig constant region or a portion thereof. In some embodiments, a chimeric protein comprising two polypeptide chains or three polypeptide chains can be encoded by a single polynucleotide chain, and then processed into two or three (or more) polypeptide chains. In yet other embodiments, a chimeric protein comprising these polypeptide chains can be encoded by two or three polynucleotide chains.

In other embodiments, the set of the polynucleotides further comprises an additional nucleotide chain (e.g., a second nucleotide chain when the chimeric polypeptide is encoded by a single polynucleotide chain or a third nucleotide chain when the chimeric protein is encoded by two polynucleotide chains) which encodes a protein convertase. The protein convertase can be selected from the group consisting of proprotein convertase subtilisin/kexin type 5 (PCSK5 or PC5), proprotein convertase subtilisin/kexin type 7 (PCSK7 or PC5), a yeast Kex 2, proprotein convertase subtilisin/kexin type 3 (PACE or PCSK3), and two or more combinations thereof. In some embodiments, the protein convertase is PACE, PC5, or PC7. In a specific embodiment, the protein convertase is PC5 or PC7. See International Application no. PCT/US2011/043568.

As used herein, an expression vector refers to any nucleic acid construct which contains the necessary elements for the transcription and translation of an inserted coding sequence, or in the case of an RNA viral vector, the necessary elements for replication and translation, when introduced into an appropriate host cell. Expression vectors can include plasmids, phagemids, viruses, and derivatives thereof.

Expression vectors of the invention will include polynucleotides encoding the chimeric protein described herein. In one embodiment, one or more of the coding sequences for the first polypeptide comprising a FVIII protein and a first Ig constant region, the second polypeptide comprising a VWF protein, an XTEN sequence having less than 288 amino acids, and a second Ig constant region or a portion thereof, or both are operably linked to an expression control sequence. As used herein, two nucleic acid sequences are operably linked when they are covalently linked in such a way as to permit each component nucleic acid sequence to retain its functionality. A coding sequence and a gene expression control sequence are said to be operably linked when they are covalently linked in such a way as to place the expression or transcription and/or translation of the coding sequence under the influence or control of the gene expression control sequence. Two DNA sequences are said to be operably linked if induction of a promoter in the 5' gene expression sequence results in the transcription of the coding sequence and if the nature of the linkage between the two DNA sequences does not (1) result in the introduction of a frame-shift mutation, (2) interfere with the ability of the promoter region to direct the transcription of the coding sequence, or (3) interfere with the ability of the corresponding RNA transcript to be translated into a protein. Thus, a gene expression sequence would be operably linked to a coding nucleic acid sequence if the gene expression sequence were capable of effecting transcription of that coding nucleic acid sequence such that the resulting transcript is translated into the desired protein or polypeptide.

A gene expression control sequence as used herein is any regulatory nucleotide sequence, such as a promoter sequence or promoter-enhancer combination, which facilitates the efficient transcription and translation of the coding nucleic acid to which it is operably linked. The gene expression control sequence may, for example, be a mammalian or viral promoter, such as a constitutive or inducible promoter. Constitutive mammalian promoters include, but are not limited to, the promoters for the following genes: hypoxanthine phosphoribosyl transferase (HPRT), adenosine deaminase, pyruvate kinase, beta-actin promoter, and other constitutive promoters. Exemplary viral promoters which function constitutively in eukaryotic cells include, for example, promoters from the cytomegalovirus (CMV), simian virus (e.g., SV40), papilloma virus, adenovirus, human immunodeficiency virus (HIV), Rous sarcoma virus, cytomegalovirus, the long terminal repeats (LTR) of Moloney leukemia virus, and other retroviruses, and the thymidine kinase promoter of herpes simplex virus. Other constitutive promoters are known to those of ordinary skill in the art. The promoters useful as gene expression sequences of the invention also include inducible promoters. Inducible promoters are expressed in the presence of an inducing agent. For example, the metallothionein promoter is induced to promote transcription and translation in the presence of certain metal ions. Other inducible promoters are known to those of ordinary skill in the art.

In general, the gene expression control sequence shall include, as necessary, 5' non-transcribing and 5' non-translating sequences involved with the initiation of transcription and translation, respectively, such as a TATA box, capping sequence, CAAT sequence, and the like. Especially, such 5' non-transcribing sequences will include a promoter region which includes a promoter sequence for transcriptional control of the operably joined coding nucleic acid. The gene expression sequences optionally include enhancer sequences or upstream activator sequences as desired.

Viral vectors include, but are not limited to, nucleic acid sequences from the following viruses: retrovirus, such as Moloney murine leukemia virus, Harvey murine sarcoma virus, murine mammary tumor virus, and Rous sarcoma virus; adenovirus, adeno-associated virus; SV40-type viruses; polyomaviruses; Epstein-Barr viruses; papilloma viruses; herpes virus; vaccinia virus; polio virus; and RNA virus such as a retrovirus. One can readily employ other vectors well-known in the art. Certain viral vectors are based on non-cytopathic eukaryotic viruses in which non-essential genes have been replaced with the gene of interest. Non-cytopathic viruses include retroviruses, the life cycle of which involves reverse transcription of genomic viral RNA into DNA with subsequent proviral integration into host cellular DNA. Retroviruses have been approved for human gene therapy trials. Most useful are those retroviruses that are replication-deficient (i.e., capable of directing synthesis of the desired proteins, but incapable of manufacturing an infectious particle). Such genetically altered retroviral expression vectors have general utility for the high efficiency transduction of genes in vivo. Standard protocols for producing replication-deficient retroviruses (including the steps of incorporation of exogenous genetic material into a plasmid, transfection of a packaging cell line with plasmid, production of recombinant retroviruses by the packaging cell line, collection of viral particles from tissue culture media, and infection of the target cells with viral particles) are provided in Kriegler, M., Gene Transfer and Expression, A Laboratory Manual, W.H. Freeman Co., New York (1990) and Murry, E. J., Methods in Molecular Biology, Vol. 7, Humana Press, Inc., Cliffton, N.J. (1991).

In one embodiment, the virus is an adeno-associated virus, a double-stranded DNA virus. The adeno-associated virus can be engineered to be replication-deficient and is capable of infecting a wide range of cell types and species. It further has advantages such as heat and lipid solvent stability; high transduction frequencies in cells of diverse lineages, including hematopoietic cells; and lack of superinfection inhibition thus allowing multiple series of transductions. Reportedly, the adeno-associated virus can integrate into human cellular DNA in a site-specific manner, thereby minimizing the possibility of insertional mutagenesis and variability of inserted gene expression characteristic of retroviral infection. In addition, wild-type adeno-associated virus infections have been followed in tissue culture for greater than 100 passages in the absence of selective pressure, implying that the adeno-associated virus genomic integration is a relatively stable event. The adeno-associated virus can also function in an extrachromosomal fashion.

Other vectors include plasmid vectors. Plasmid vectors have been extensively described in the art and are well-known to those of skill in the art. See, e.g., Sambrook et al., Molecular Cloning: A Laboratory Manual, Second Edition, Cold Spring Harbor Laboratory Press, 1989. In the last few years, plasmid vectors have been found to be particularly advantageous for delivering genes to cells in vivo because of their inability to replicate within and integrate into a host genome. These plasmids, however, having a promoter compatible with the host cell, can express a peptide from a gene operably encoded within the plasmid. Some commonly used plasmids available from commercial suppliers include pBR322, pUC18, pUC19, various pcDNA plasmids, pRC/CMV, various pCMV plasmids, pSV40, and pBlueScript. Additional examples of specific plasmids include pcDNA3.1, catalog number V79020; pcDNA3.1/hygro, catalog number V87020; pcDNA4/myc-His, catalog number V86320; and pBudCE4.1, catalog number V53220, all from Invitrogen (Carlsbad, Calif.). Other plasmids are well-known to those of ordinary skill in the art. Additionally, plasmids may be custom designed using standard molecular biology techniques to remove and/or add specific fragments of DNA.

In one insect expression system that may be used to produce the proteins of the invention, *Autographa californica* nuclear polyhidrosis virus (AcNPV) is used as a vector to express the foreign genes. The virus grows in *Spodoptera frugiperda* cells. A coding sequence may be cloned into non-essential regions (for example, the polyhedron gene) of the virus and placed under control of an ACNPV promoter (for example, the polyhedron promoter). Successful insertion of a coding sequence will result in inactivation of the polyhedron gene and production of non-occluded recombinant virus (i.e., virus lacking the proteinaceous coat coded for by the polyhedron gene). These recombinant viruses are then used to infect *Spodoptera frugiperda* cells in which the inserted gene is expressed. (see, e.g., Smith et al. (1983) *J Virol* 46:584; U.S. Pat. No. 4,215,051). Further examples of this expression system may be found in Ausubel et al., eds. (1989) Current Protocols in Molecular Biology, Vol. 2, Greene Publish. Assoc. & Wiley Interscience.

Another system which can be used to express the proteins of the invention is the glutamine synthetase gene expression system, also referred to as the "GS expression system" (Lonza Biologics PLC, Berkshire UK). This expression system is described in detail in U.S. Pat. No. 5,981,216.

In mammalian host cells, a number of viral based expression systems may be utilized. In cases where an adenovirus is used as an expression vector, a coding sequence may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing peptide in infected hosts. See, e.g., Logan & Shenk (1984) *Proc Natl Acad Sci USA* 81:3655). Alternatively, the vaccinia 7.5 K promoter may be used. See, e.g., Mackett et al. (1982) *Proc Natl Acad Sci USA* 79:7415; Mackett et al. (1984) *J Virol* 49:857; Panicali et al. (1982) *Proc Natl Acad Sci USA* 79:4927.

To increase efficiency of production, the polynucleotides can be designed to encode multiple units of the protein of the invention separated by enzymatic cleavage sites. The resulting polypeptide can be cleaved (e.g., by treatment with the appropriate enzyme) in order to recover the polypeptide units. This can increase the yield of polypeptides driven by a single promoter. When used in appropriate viral expression systems, the translation of each polypeptide encoded by the mRNA is directed internally in the transcript; e.g., by an internal ribosome entry site, IRES. Thus, the polycistronic construct directs the transcription of a single, large polycistronic mRNA which, in turn, directs the translation of multiple, individual polypeptides. This approach eliminates the production and enzymatic processing of polyproteins and may significantly increase the yield of polypeptides driven by a single promoter.

Vectors used in transformation will usually contain a selectable marker used to identify transformants. In bacterial systems, this can include an antibiotic resistance gene such as ampicillin or kanamycin. Selectable markers for use in cultured mammalian cells include genes that confer resistance to drugs, such as neomycin, hygromycin, and methotrexate. The selectable marker may be an amplifiable selectable marker. One amplifiable selectable marker is the dihydrofolate reductase (DHFR) gene. Simonsen C C et al. (1983) *Proc Natl Acad Sci USA* 80:2495-9. Selectable markers are reviewed by Thilly (1986) Mammalian Cell Technology, Butterworth Publishers, Stoneham, Mass., and the choice of selectable markers is well within the level of ordinary skill in the art.

Selectable markers may be introduced into the cell on a separate plasmid at the same time as the gene of interest, or they may be introduced on the same plasmid. If on the same plasmid, the selectable marker and the gene of interest may be under the control of different promoters or the same promoter, the latter arrangement producing a dicistronic message. Constructs of this type are known in the art (for example, U.S. Pat. No. 4,713,339).

The expression vectors can encode for tags that permit easy purification of the recombinantly produced protein. Examples include, but are not limited to, vector pUR278 (Ruther et al. (1983) *EMBO J* 2:1791), in which coding sequences for the protein to be expressed may be ligated into the vector in frame with the lac z coding region so that a tagged fusion protein is produced; pGEX vectors may be used to express proteins of the invention with a glutathione 5-transferase (GST) tag. These proteins are usually soluble and can easily be purified from cells by adsorption to glutathione-agarose beads followed by elution in the presence of free glutathione. The vectors include cleavage sites (thrombin or Factor Xa protease or PRESCISSION PROTEASE™ (Pharmacia, Peapack, N.J.)) for easy removal of the tag after purification.

The expression vector or vectors are then transfected or co-transfected into a suitable target cell, which will express the polypeptides. Transfection techniques known in the art include, but are not limited to, calcium phosphate precipitation (Wigler et al. (1978) *Cell* 14:725), electroporation (Neumann et al. (1982) *EMBO J* 1:841), and liposome-based reagents. A variety of host-expression vector systems may be utilized to express the proteins described herein including both prokaryotic and eukaryotic cells. These include, but are not limited to, microorganisms such as bacteria (e.g., *E. coli*) transformed with recombinant bacteriophage DNA or plasmid DNA expression vectors containing an appropriate coding sequence; yeast or filamentous fungi transformed with recombinant yeast or fungi expression vectors containing an appropriate coding sequence; insect cell systems infected with recombinant virus expression vectors (e.g., baculovirus) containing an appropriate coding sequence; plant cell systems infected with recombinant virus expression vectors (e.g., cauliflower mosaic virus or tobacco mosaic virus) or transformed with recombinant plasmid expression vectors (e.g., Ti plasmid) containing an appropriate coding sequence; or animal cell systems, including mammalian cells (e.g., HEK 293, CHO, Cos, HeLa, HKB11, and BHK cells).

In one embodiment, the host cell is a eukaryotic cell. As used herein, a eukaryotic cell refers to any animal or plant cell having a definitive nucleus. Eukaryotic cells of animals include cells of vertebrates, e g., mammals, and cells of invertebrates, e.g., insects. Eukaryotic cells of plants specifically can include, without limitation, yeast cells. A eukaryotic cell is distinct from a prokaryotic cell, e.g., bacteria.

In certain embodiments, the eukaryotic cell is a mammalian cell. A mammalian cell is any cell derived from a mammal Mammalian cells specifically include, but are not limited to, mammalian cell lines. In one embodiment, the mammalian cell is a human cell. In another embodiment, the mammalian cell is a HEK 293 cell, which is a human embryonic kidney cell line. HEK 293 cells are available as CRL-1533 from American Type Culture Collection, Manassas, Va., and as 293-H cells, Catalog No. 11631-017 or 293-F cells, Catalog No. 11625-019 from Invitrogen (Carlsbad, Calif.). In some embodiments, the mammalian cell is a PER.C6® cell, which is a human cell line derived from retina. PER.C6® cells are available from Crucell (Leiden, The Netherlands). In other embodiments, the mammalian cell is a Chinese hamster ovary (CHO) cell. CHO cells are available from American Type Culture Collection, Manassas, Va. (e.g., CHO-K1; CCL-61). In still other embodiments, the mammalian cell is a baby hamster kidney (BHK) cell. BHK cells are available from American Type Culture Collection, Manassas, Va. (e.g., CRL-1632). In some embodiments, the mammalian cell is a HKB11 cell, which is a hybrid cell line of a HEK293 cell and a human B cell line. Mei et al., *Mol. Biotechnol.* 34(2): 165-78 (2006).

In one embodiment, a plasmid including a FVIII(X2)-Fc fusion coding sequence, a VWF protein-L1-X1-L2-Fc coding sequence, or both and a selectable marker, e.g., zeocin resistance, are transfected into HEK 293 cells, for production of a chimeric protein.

In another embodiment, a plasmid including a FVIII-Fc fusion coding sequence, a VWF protein-L1-X-L2-Fc coding sequence, or both and a selectable marker, e.g., zeocin resistance, are transfected into HEK 293 cells, for production of a chimeric protein.

In some embodiments, a first plasmid including a FVIII (X2)-Fc fusion coding sequence and a first selectable marker, e.g., a zeocin resistance gene, and a second plasmid including a VWF protein-L1-X1-L2-Fc coding sequence and a second selectable marker, e.g., a neomycin resistance gene, and a third plasmid including a protein convertase coding sequence and a third selectable marker, e.g., a hygromycin resistance gene, are cotransfected into HEK 293 cells, for production of the chimeric protein. The first and second plasmids can be introduced in equal amounts (i.e., 1:1 molar ratio), or they can be introduced in unequal amounts.

In still other embodiments, a first plasmid including a FVIII-Fc fusion coding sequence and a first selectable marker, e.g., a zeocin resistance gene, and a second plasmid including a VWF protein-L1-X-L2-Fc coding sequence and a second selectable marker, e.g., a neomycin resistance gene, and a third plasmid including a protein convertase coding sequence and a third selectable marker, e.g., a hygromycin resistance gene, are cotransfected into HEK 293 cells, for production of the chimeric protein. The first and second plasmids can be introduced in equal amounts (i.e., 1:1 molar ratio), or they can be introduced in unequal amounts.

In yet other embodiments, a first plasmid including a FVIII(X2)-Fc fusion coding sequence and a first selectable marker, e.g., a zeocin resistance gene, and a second plasmid including a VWF protein-L1-X1-L2-Fc fusion coding sequence and a second selectable marker, e.g., a neomycin resistance gene, and a third plasmid including a protein convertase coding sequence and a third selectable marker, e.g., a hygromycin resistance gene, are cotransfected into HEK 293 cells, for production of the chimeric protein. The first and second plasmids can be introduced in equal amounts (i.e., 1:1 molar ratio), or they can be introduced in unequal amounts.

In certain embodiments, a first plasmid, including a chimeric protein encoding FVIII (with or without XTEN)-F1-L3-F2-L2-X-L1-V coding sequence and a first selectable marker, e.g., a zeocin resistance gene, and a second plasmid including a protein convertase coding sequence and a second selectable marker, e.g., a hygromycin resistance gene, are cotransfected into HEK 293 cells, for production of the chimeric protein. The promoters for the FVIII(X)-F1 coding sequence and the V-L2-X-L1-F2 coding sequence can be different or they can be the same.

In still other embodiments, transfected cells are stably transfected. These cells can be selected and maintained as a stable cell line, using conventional techniques known to those of skill in the art.

Host cells containing DNA constructs of the protein are grown in an appropriate growth medium. As used herein, the term "appropriate growth medium" means a medium containing nutrients required for the growth of cells. Nutrients required for cell growth may include a carbon source, a nitrogen source, essential amino acids, vitamins, minerals, and growth factors. Optionally, the media can contain one or more selection factors. Optionally the media can contain bovine calf serum or fetal calf serum (FCS). In one embodiment, the media contains substantially no IgG. The growth medium will generally select for cells containing the DNA construct by, for example, drug selection or deficiency in an essential nutrient which is complemented by the selectable marker on the DNA construct or co-transfected with the DNA construct. Cultured mammalian cells are generally grown in commercially available serum-containing or serum-free media (e.g., MEM, DMEM, DMEM/F12). In one embodiment, the medium is CD293 (Invitrogen, Carlsbad, Calif.). In another embodiment, the medium is CD17 (Invitrogen, Carlsbad, Calif.). Selection of a medium appropriate for the particular cell line used is within the level of those ordinary skilled in the art.

In order to co-express the two polypeptide chains of the chimeric protein, the host cells are cultured under conditions that allow expression of both chains. As used herein, culturing refers to maintaining living cells in vitro for at least a definite time. Maintaining can, but need not include, an increase in population of living cells. For example, cells maintained in culture can be static in population, but still viable and capable of producing a desired product, e.g., a recombinant protein or recombinant fusion protein. Suitable conditions for culturing eukaryotic cells are well known in the art and include appropriate selection of culture media, media supplements, temperature, pH, oxygen saturation, and the like. For commercial purposes, culturing can include the use of any of various types of scale-up systems including shaker flasks, roller bottles, hollow fiber bioreactors, stirred-tank bioreactors, airlift bioreactors, Wave bioreactors, and others.

The cell culture conditions are also selected to allow association of the VWF fragment with the FVIII protein. Conditions that allow expression of the VWF fragment and/or the FVIII protein may include the presence of a source of vitamin K. For example, in one embodiment, stably transfected HEK 293 cells are cultured in CD293 media (Invitrogen, Carlsbad, Calif.) or OptiCHO media (Invitrogen, Carlsbad, Calif.) supplemented with 4 mM glutamine.

In one aspect, the present invention is directed to a method of expressing, making, or producing the chimeric protein of the invention comprising a) transfecting a host cell comprising a polynucleotide encoding the chimeric protein and b) culturing the host cell in a culture medium under a condition suitable for expressing the chimeric protein, wherein the chimeric protein is expressed.

In further embodiments, the protein product containing the FVIII protein linked to a first Ig constant region or a portion thereof and/or the VWF protein fused to a second Ig constant region or a portion thereof by an XTEN sequence is secreted into the media. Media is separated from the cells, concentrated, filtered, and then passed over two or three affinity columns, e.g., a protein A column and one or two anion exchange columns.

In certain aspects, the present invention relates to the chimeric protein produced by the methods described herein.

In vitro production allows scale-up to give large amounts of the desired altered polypeptides of the invention. Techniques for mammalian cell cultivation under tissue culture conditions are known in the art and include homogeneous suspension culture, e.g. in an airlift reactor or in a continuous stirrer reactor, or immobilized or entrapped cell culture, e.g. in hollow fibers, microcapsules, on agarose microbeads or ceramic cartridges. If necessary and/or desired, the solutions of polypeptides can be purified by the customary chromatography methods, for example gel filtration, ion-exchange chromatography, hydrophobic interaction chromatography (HIC, chromatography over DEAE-cellulose or affinity chromatography.

IV. PHARMACEUTICAL COMPOSITION

Compositions containing the chimeric protein of the present invention may contain a suitable pharmaceutically acceptable carrier. For example, they may contain excipients and/or auxiliaries that facilitate processing of the active compounds into preparations designed for delivery to the site of action.

The pharmaceutical composition can be formulated for parenteral administration (i.e. intravenous, subcutaneous, or intramuscular) by bolus injection. Formulations for injection can be presented in unit dosage form, e.g., in ampoules or in multidose containers with an added preservative. The compositions can take such forms as suspensions, solutions, or emulsions in oily or aqueous vehicles, and contain formulatory agents such as suspending, stabilizing and/or dispersing agents. Alternatively, the active ingredient can be in powder form for constitution with a suitable vehicle, e.g., pyrogen free water.

Suitable formulations for parenteral administration also include aqueous solutions of the active compounds in water-soluble form, for example, water-soluble salts. In addition, suspensions of the active compounds as appropriate oily injection suspensions may be administered. Suitable lipophilic solvents or vehicles include fatty oils, for example, sesame oil, or synthetic fatty acid esters, for example, ethyl oleate or triglycerides. Aqueous injection suspensions may contain substances, which increase the viscosity of the suspension, including, for example, sodium carboxymethyl cellulose, sorbitol and dextran. Optionally, the suspension may also contain stabilizers. Liposomes also can be used to encapsulate the molecules of the invention for delivery into cells or interstitial spaces. Exemplary pharmaceutically acceptable carriers are physiologically compatible solvents, dispersion media, coatings, antibacterial and antifungal agents, isotonic and absorption delaying agents, water, saline, phosphate buffered saline, dextrose, glycerol, ethanol and the like. In some embodiments, the composition comprises isotonic agents, for example, sugars, polyalcohols such as mannitol, sorbitol, or sodium chloride. In other embodiments, the compositions comprise pharmaceutically acceptable substances such as wetting agents or minor amounts of auxiliary substances such as wetting or emulsifying agents, preservatives or buffers, which enhance the shelf life or effectiveness of the active ingredients.

Compositions of the invention may be in a variety of forms, including, for example, liquid (e.g., injectable and infusible solutions), dispersions, suspensions, semi-solid and solid dosage forms. The preferred form depends on the mode of administration and therapeutic application.

The composition can be formulated as a solution, micro emulsion, dispersion, liposome, or other ordered structure suitable to high drug concentration. Sterile injectable solutions can be prepared by incorporating the active ingredient in the required amount in an appropriate solvent with one or a combination of ingredients enumerated above, as required, followed by filtered sterilization. Generally, dispersions are prepared by incorporating the active ingredient into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The active ingredient can be formulated with a controlled-release formulation or device. Examples of such formulations and devices include implants, transdermal patches, and microencapsulated delivery systems. Biodegradable, biocompatible polymers can be used, for example, ethylene vinyl acetate, polyanhydrides, polyglycolic acid, collagen, polyorthoesters, and polylactic acid. Methods for the preparation of such formulations and devices are known in the art. See e.g., Sustained and Controlled Release Drug Delivery Systems, J. R. Robinson, ed., Marcel Dekker, Inc., New York, 1978.

Injectable depot formulations can be made by forming microencapsulated matrices of the drug in biodegradable polymers such as polylactide-polyglycolide. Depending on the ratio of drug to polymer, and the nature of the polymer employed, the rate of drug release can be controlled. Other exemplary biodegradable polymers are polyorthoesters and polyanhydrides. Depot injectable formulations also can be prepared by entrapping the drug in liposomes or microemulsions.

Supplementary active compounds can be incorporated into the compositions. In one embodiment, the chimeric protein of the invention is formulated with another clotting factor, or a variant, fragment, analogue, or derivative thereof. For example, the clotting factor includes, but is not limited to, factor V, factor VII, factor VIII, factor IX, factor X, factor XI, factor XII, factor XIII, prothrombin, fibrinogen, von Willebrand factor or recombinant soluble tissue factor (rsTF) or activated forms of any of the preceding. The clotting factor of hemostatic agent can also include antifibrinolytic drugs, e.g., epsilon-amino-caproic acid, tranexamic acid.

Dosage regimens may be adjusted to provide the optimum desired response. For example, a single bolus may be administered, several divided doses may be administered over time, or the dose may be proportionally reduced or increased as indicated by the exigencies of the therapeutic situation. It is advantageous to formulate parenteral compositions in dosage unit form for ease of administration and uniformity of dosage. See, e.g., Remington's Pharmaceutical Sciences (Mack Pub. Co., Easton, Pa. 1980).

In addition to the active compound, the liquid dosage form may contain inert ingredients such as water, ethyl alcohol, ethyl carbonate, ethyl acetate, benzyl alcohol, benzyl benzoate, propylene glycol, 1,3-butylene glycol, dimethylformamide, oils, glycerol, tetrahydrofurfuryl alcohol, polyethylene glycols, and fatty acid esters of sorbitan.

Non-limiting examples of suitable pharmaceutical carriers are also described in Remington's Pharmaceutical Sciences by E. W. Martin. Some examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol, and the like. The composition can also contain pH buffering reagents, and wetting or emulsifying agents.

For oral administration, the pharmaceutical composition can take the form of tablets or capsules prepared by conventional means. The composition can also be prepared as a liquid for example a syrup or a suspension. The liquid can include suspending agents (e.g., sorbitol syrup, cellulose derivatives or hydrogenated edible fats), emulsifying agents (lecithin or acacia), non-aqueous vehicles (e.g., almond oil, oily esters, ethyl alcohol, or fractionated vegetable oils), and preservatives (e.g., methyl or propyl-p-hydroxybenzoates or sorbic acid). The preparations can also include flavoring, coloring and sweetening agents. Alternatively, the composition can be presented as a dry product for constitution with water or another suitable vehicle.

For buccal administration, the composition may take the form of tablets or lozenges according to conventional protocols.

For administration by inhalation, the compounds for use according to the present invention are conveniently delivered in the form of a nebulized aerosol with or without excipients or in the form of an aerosol spray from a pressurized pack or nebulizer, with optionally a propellant, e.g., dichlorodifluoromethane, trichlorofluoromethane, dichlorotetrafluoromethane, carbon dioxide or other suitable gas. In the case of a pressurized aerosol the dosage unit can be determined by providing a valve to deliver a metered amount. Capsules and cartridges of, e.g., gelatin for use in an inhaler or insufflator can be formulated containing a powder mix of the compound and a suitable powder base such as lactose or starch.

The pharmaceutical composition can also be formulated for rectal administration as a suppository or retention enema, e.g., containing conventional suppository bases such as cocoa butter or other glycerides.

In one embodiment, a pharmaceutical composition comprises a chimeric protein, the polynucleotide encoding the chimeric protein, the vector comprising the polynucleotide, or the host cell comprising the vector, and a pharmaceutically acceptable carrier. The FVIII protein in a chimeric protein has extended half-life compared to wild type FVIII protein or the corresponding FVIII protein without the VWF fragment. In one embodiment, wherein the half-life of the chimeric protein is extended at least about 1.5 times, at least about 2 times, at least about 2.5 times, at least about 3 times, at least about 4 times, at least about 5 times, at least about 6 times, at least about 7 times, at least about 8 times, at least about 9 times, at least about 10 times, at least about 11 times, or at least about 12 times longer than wild type FVIII. In another embodiment, the half-life of Factor VIII is at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 48 hours, at least about 60 hours, at least about 72 hours, at least about 84 hours, at least about 96 hours, or at least about 108 hours.

In some embodiments, the composition is administered by a route selected from the group consisting of topical administration, intraocular administration, parenteral administration, intrathecal administration, subdural administration and oral administration. The parenteral administration can be intravenous or subcutaneous administration.

In other embodiments, the composition is used to treat a bleeding disease or condition in a subject in need thereof. The bleeding disease or condition is selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, bleeding in the illiopsoas sheath and any combinations thereof. In still other embodiments, the subject is scheduled to undergo a surgery. In yet other embodiments, the treatment is prophylactic or on-demand

V. GENE THERAPY

A chimeric protein thereof of the invention can be produced in vivo in a mammal, e.g., a human patient, using a gene therapy approach to treatment of a bleeding disease or disorder selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath would be therapeutically beneficial. In one embodiment, the bleeding disease or disorder is hemophilia. In another embodiment, the bleeding disease or disorder is hemophilia A. This involves administration of a suitable chimeric protein-encoding nucleic acid operably linked to suitable expression control sequences. In certain embodiment, these sequences are incorporated into a viral vector. Suitable viral vectors for such gene therapy include adenoviral vectors, lentiviral vectors, baculoviral vectors, Epstein Barr viral vectors, papovaviral vectors, vaccinia viral vectors, herpes simplex viral vectors, and adeno associated virus (AAV) vectors. The viral vector can be a replication-defective viral vector. In other embodiments, an adenoviral vector has a deletion in its E1 gene or E3 gene. When an adenoviral vector is used, the mammal may not be exposed to a nucleic acid encoding a selectable marker gene. In other embodiments, the sequences are incorporated into a non-viral vector known to those skilled in the art.

VI. METHODS OF USING CHIMERIC PROTEIN

The present invention is directed to a method of using a chimeric protein described herein to prevent or inhibit endogenous VWF binding to a FVIII protein. The present invention is also directed to a method of using a chimeric protein having a FVIII protein linked to XTEN and an Ig constant region or a portion thereof.

One aspect of the present invention is directed to preventing or inhibiting FVIII interaction with endogenous VWF by blocking or shielding the VWF binding site on the FVIII from endogenous VWF and at the same time extending half-life of the chimeric protein using an XTEN sequence in combination with an Ig constant region or a portion thereof, which can also be a half-life extender. In one embodiment, the invention is directed to a method of constructing a FVIII protein having half-life longer than wild-type FVIII. The chimeric protein useful in the method includes any one or more chimeric protein described herein.

Another aspect of the invention includes a method of administering to a subject in need thereof a chimeric protein comprising a FVIII protein having half-life longer than wild-type FVIII, wherein the method comprises administering the chimeric protein described herein to the subject.

In one embodiment, the invention is directed to a method of using an XTEN sequence and an Ig constant region or a portion thereof to improve a half-life of a chimeric protein comprising FVIII protein and a VWF protein, which prevents or inhibits endogenous VWF interaction with a FVIII protein. A FVIII protein linked to an XTEN sequence (e.g., FVIII(X)) and then bound to or associated with a VWF protein fused to an XTEN and an Ig constant region or a portion thereof is shielded or protected from the clearance pathway of VWF and thus has reduced clearance compared to the FVIII protein not bound to the VWF protein. The shielded FVIII protein thus has maximum extension of a half-life compared to a FVIII protein not bound to or associated with the XTEN sequence and the VWF protein. In certain embodiments, the FVIII protein associated with or protected by a VWF protein and linked to an XTEN sequence is not cleared by a VWF clearance receptor. In other embodiments, the FVIII protein associated with or protected by a VWF protein and linked to an XTEN sequence is cleared from the system slower than the FVIII protein that is not associated with or protected by the VWF protein and linked to the XTEN sequence.

In one aspect, the chimeric protein comprising the FVIII protein linked to an XTEN sequence or the FVIII protein bound to or associated with a VWF protein linked to XTEN has reduced clearance from circulation as the VWF protein does not contain a VWF clearance receptor binding site. The VWF protein prevents or inhibits clearance of FVIII bound to or associated with the VWF protein from the system through the VWF clearance pathway. The VWF proteins useful for the present invention can also provide at least one or more VWF-like FVIII protection properties that are provided by endogenous VWF. In certain embodiments, the VWF protein or the XTEN sequence can also mask one or more FVIII clearance receptor binding site, thereby preventing clearance of FVIII by its own clearance pathway.

In some embodiments, the prevention or inhibition of a FVIII protein binding to endogenous VWF by the VWF protein or the XTEN sequence can be in vitro or in vivo.

Also provided is a method of increasing the half-life of a chimeric protein comprising administering the chimeric protein described herein to a subject in need thereof. The half-life of non-activated FVIII bound to or associated with full-length VWF is about 12 to 14 hours in plasma. In VWD type 3, wherein there is almost no VWF in circulation, the half-life of FVIII is only about six hours, leading to symptoms of mild to moderate hemophilia A in such patients due to decreased concentrations of FVIII. The half-life of the chimeric protein linked to or associated with the VWF fragment or the XTEN sequence of the present invention can increase at least about 1.5 times, 1.6 times, 1.7 times, 1.8 times, 1.9 times, 2.0 times, 2.1 times, 2.2 times, 2.3 times, 2.4 times, 2.6 times, 2.7. times, 2.8 times, 2.9 times, 3.0 times, 3.1 times, 3.2 times, 3.3 times, 3.4 times, 3.5 times, 3.6 times, 3.7 times, 3.8 times, 3.9 times, or 4.0 times higher than the half-life of the non-activated FVIII bound to or associated with full-length VWF.

In one embodiment, a chimeric protein comprising a first polypeptide comprising a FVIII protein and a first Ig constant region or a portion thereof and a second polypeptide comprising a VWF protein, an XTEN having less than 288 amino acids, and an Ig constant region or a portion thereof exhibits a half-life at least about 2 times, 2.5 times, 3.0 times, 3.5 times, 4.0 times, 4.5 times, 5.0 times, 5.5 times, 6.0 times, 7 times, 8 times, 9 times, or 10 times higher than a corresponding chimeric protein comprising the same first polypeptide and the second polypeptide without the XTEN sequence or wild type FVIII. In another embodiment, a chimeric protein comprising a first polypeptide comprising a FVIII protein and a first Ig constant region or a portion thereof and a second polypeptide comprising a VWF protein, an XTEN having less than 288 amino acids, and an Ig constant region or a portion thereof exhibits a half-life about 2 to about 5 times, about 3 to about 10 times, about 5 to about 15 times, about 10 to about 20 times, about 15 to about 25 times, about 20 to about 30 times, about 25 to about 35 times, about 30 to about 40 times, about 35 to about 45 times higher than a corresponding chimeric protein comprising the same first polypeptide and the second polypeptide without the XTEN sequence or wild type FVIII. In a specific embodiment, the half-life of a chimeric protein of the invention increases at least about 30, 31, 32, 33, 34, 35, 36, 37, 38, 39, or 40 times higher than the half-life of the wild type FVIII in a FVIII and VWF double knockout mouse.

In certain embodiments, a chimeric protein exhibits a half-life of about 40 hours in mice.

In some embodiments, the half-life of a chimeric protein is longer than the half-life of a FVIII associated with endogenous VWF. In other embodiments, the half-life of the chimeric protein is at least about 1.5 times, 2 times, 2.5 times, 3.5 times, 3.6 times, 3.7 times, 3.8 times, 3.9 times, 4.0 times, 4.5 times, or 5.0 times the half-life of wild type FVIII or a FVIII protein associated with endogenous VWF.

In some embodiments, as a result of the invention the half-life of the chimeric protein is extended compared to a FVIII protein without the VWF protein or wild-type FVIII. The half-life of the chimeric protein of the invention is at least about 1.5 times, at least about 2 times, at least about 2.5 times, at least about 3 times, at least about 4 times, at least about 5 times, at least about 6 times, at least about 7 times, at least about 8 times, at least about 9 times, at least about 10 times, at least about 11 times, or at least about 12 times longer than the half-life of a chimeric protein without the VWF protein or wild-type FVIII. In one embodiment, the half-life of FVIII is about 1.5-fold to about 20-fold, about 1.5 fold to about 15 fold, or about 1.5 fold to about 10 fold longer than the half-life of wild-type FVIII. In another embodiment, the half-life of the FVIII is extended about 2-fold to about 10-fold, about 2-fold to about 9-fold, about 2-fold to about 8-fold, about 2-fold to about 7-fold, about 2-fold to about 6-fold, about 2-fold to about 5-fold, about 2-fold to about 4-fold, about 2-fold to about 3-fold, about 2.5-fold to about 10-fold, about 2.5-fold to about 9-fold, about 2.5-fold to about 8-fold, about 2.5-fold to about 7-fold, about 2.5-fold to about 6-fold, about 2.5-fold to about 5-fold, about 2.5-fold to about 4-fold, about 2.5-fold to about 3-fold, about 3-fold to about 10-fold, about 3-fold to about 9-fold, about 3-fold to about 8-fold, about 3-fold to about 7-fold, about 3-fold to about 6-fold, about 3-fold to about 5-fold, about 3-fold to about 4-fold, about 4-fold to about 6 fold, about 5-fold to about 7-fold, or about 6-fold to about 8 fold as compared to wild-type FVIII or a FVIII protein without the VWF protein. In other embodiments, the half-life of the chimeric protein of the invention is at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 40 hours, at least about 48 hours, at least about 60 hours, at least about 72 hours, at least about 84 hours, at least about 96 hours, or at least about 108 hours. In still other embodiments, the half-life of the chimeric protein of the invention is about 15 hours to about two weeks, about 16 hours to about one week, about 17 hours to about one week, about 18 hours to about one week, about 19 hours to about one week, about 20 hours to about one week, about 21 hours to about one week, about 22 hours to about one week, about 23 hours to about one week, about 24 hours to about one week, about 36 hours to about one week, about 48 hours to about one week, about 60 hours to about one week, about 24 hours to about six days, about 24 hours to about five days, about 24 hours to about four days, about 24 hours to about three days, or about 24 hours to about two days.

In some embodiments, the average half-life of the chimeric protein of the invention per subject is about 15 hours, about 16 hours, about 17 hours, about 18 hours, about 19 hours, about 20 hours, about 21 hours, about 22 hours, about 23 hours, about 24 hours (1 day), about 25 hours, about 26 hours, about 27 hours, about 28 hours, about 29 hours, about 30 hours, about 31 hours, about 32 hours, about 33 hours, about 34 hours, about 35 hours, about 36 hours, about 40 hours, about 44 hours, about 48 hours (2 days), about 54 hours, about 60 hours, about 72 hours (3 days), about 84 hours, about 96 hours (4 days), about 108 hours, about 120 hours (5 days), about six days, about seven days (one week), about eight days, about nine days, about 10 days, about 11 days, about 12 days, about 13 days, or about 14 days.

In addition, the invention provides a method of treating or preventing a bleeding disease or disorder comprising administering an effective amount of a chimeric protein. In one embodiment, the bleeding disease or disorder is selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath. In a specific embodiment, the bleeding disease or disorder is hemophilia A.

The chimeric protein comprising an XTEN sequence and an Ig constant region or a portion thereof in combination with a VWF protein described herein, that prevents or inhibits interaction of the FVIII protein with endogenous VWF prepared by the invention, has many uses as will be recognized by one skilled in the art, including, but not limited to methods of treating a subject having a hemostatic disorder and methods of treating a subject in need of a general hemostatic agent. In one embodiment, the invention relates to a method of treating a subject having a hemostatic disorder comprising administering a therapeutically effective amount of the chimeric protein.

The FVIII protein portion in the chimeric protein treats or prevents a hemostatic disorder by serving as a cofactor to Factor IX on a negatively charged phospholipid surface, thereby forming a Xase complex. The binding of activated coagulation factors to a phospholipid surface localizes this process to sites of vascular damage. On a phospholipid surface, Factor VIIIa increases the maximum velocity of Factor X activation by Factor IXa, by approximately 200,000-fold, leading to the large second burst of thrombin generation.

The chimeric protein of the invention can be used to treat any hemostatic disorder. The hemostatic disorders that may be treated by administration of the chimeric protein of the invention include, but are not limited to, hemophilia A, as well as deficiencies or structural abnormalities relating to Factor VIII. In one embodiment, the hemostatic disorder is hemophilia A.

The chimeric protein of the invention can be used prophylactically to treat a subject with a hemostatic disorder. The chimeric protein of the invention can be used to treat an acute bleeding episode in a subject with a hemostatic disorder. In another embodiment, the hemostatic disorder can be the result of a defective clotting factor, e.g., von Willebrand's factor. In one embodiment, the hemostatic disorder is an inherited disorder. In another embodiment, the hemostatic disorder is an acquired disorder. The acquired disorder can result from an underlying secondary disease or condition. The unrelated condition can be, as an example, but not as a limitation, cancer, an auto-immune disease, or pregnancy. The acquired disorder can result from old age or from medication to treat an underlying secondary disorder (e.g. cancer chemotherapy).

The invention also relates to methods of treating a subject that does not have a congenital hemostatic disorder, but has a secondary disease or condition resulting in acquisition of a hemostatic disorder, e.g., due to development of an anti-FVIII antibody or a surgery. The invention thus relates to a method of treating a subject in need of a general hemostatic agent comprising administering a therapeutically effective amount of the chimeric protein prepared by the present methods.

The present invention is also related to methods of reducing immunogenicity of FVIII or inducing less immunogenicity against FVIII comprising administering an effective amount of the chimeric proteins described herein, or the polynucleotides encoding the same.

In one embodiment, the subject in need of a general hemostatic agent is undergoing, or is about to undergo, surgery. The chimeric protein of the invention can be administered prior to, during, or after surgery as a prophylactic regimen. The chimeric protein of the invention can be administered prior to, during, or after surgery to control an acute bleeding episode.

The chimeric protein of the invention can be used to treat a subject having an acute bleeding episode who does not have a hemostatic disorder. The acute bleeding episode can result from severe trauma, e.g., surgery, an automobile accident, wound, laceration gun shot, or any other traumatic event resulting in uncontrolled bleeding. Non limiting examples of bleeding episodes include a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, bleeding in the illiopsoas sheath, and any combinations thereof.

In prophylactic applications, one or more compositions containing the chimeric protein of the invention or a cocktail thereof are administered to a patient not already in the disease state to enhance the patient's resistance or reduce symptoms associated with a disease or disorder. Such an amount is defined to be a "prophylactic effective dose." In therapeutic applications, a relatively high dosage (e.g., from about 1 to 400 mg/kg of polypeptide per dose, with dosages of from 5 to 25 mg being more commonly used for radioimmuno conjugates and higher doses for cytotoxin-drug modified polypeptides) at relatively short intervals is sometimes required until progression of the disease is reduced or terminated, and until the patient shows partial or complete amelioration of symptoms of disease. Thereafter, the patient can be administered a prophylactic regime.

In some embodiments, a chimeric protein or a composition of the invention is used for on-demand treatment, which includes treatment for a bleeding episode, hemarthrosis, muscle bleed, oral bleed, hemorrhage, hemorrhage into muscles, oral hemorrhage, trauma, trauma capitis (head trauma), gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, or bleeding in the illiopsoas sheath. The subject may be in need of surgical prophylaxis, peri-operative management, or treatment for surgery. Such surgeries include, e.g., minor surgery, major surgery, tooth extraction, tonsillectomy, inguinal herniotomy, synovectomy, total knee replacement, craniotomy, osteosynthesis, trauma surgery, intracranial surgery, intra-abdominal surgery, intrathoracic surgery, or joint replacement surgery.

In one embodiment, the chimeric protein of the present invention is administered intravenously, subcutaneously, intramuscularly, or via any mucosal surface, e.g., orally, sublingually, buccally, nasally, vaginally or via pulmonary route. The chimeric protein comprising a VWF fragment and a FVIII protein of the present invention can be implanted within or linked to a biopolymer solid support that allows for the slow release of the chimeric protein to the site of bleeding or implanted into bandage/dressing. The dose of the chimeric protein will vary depending on the subject and upon the particular route of administration used. Dosages can range from 0.1 to 100,000 µg/kg body weight. In one embodiment, the dosing range is 0.1-1,000 µg/kg. In another embodiment, the dosing range is 0.1-500 µg/kg. The protein can be administered continuously or at specific timed intervals. In vitro assays may be employed to determine optimal dose ranges and/or schedules for administration. In vitro assays that measure clotting factor activity are known in the art, e.g., STA-CLOT VIIa-rTF clotting assay or ROTEM clotting assay. Additionally, effective doses may be extrapolated from dose-response curves obtained from animal models, e.g., a hemophiliac dog (Mount et al. 2002, *Blood* 99(8):2670).

Having now described the present invention in detail, the same will be more clearly understood by reference to the following examples, which are included herewith for purposes of illustration only and are not intended to be limiting of the invention. All patents, publications, and articles referred to herein are expressly and specifically incorporated herein by reference.

EXAMPLES

Throughout the examples, the following materials and methods were used unless otherwise stated.

Materials and Methods

In general, the practice of the present invention employs, unless otherwise indicated, conventional techniques of chemistry, biophysics, molecular biology, recombinant DNA technology, immunology (especially, e.g., antibody technology), and standard techniques in electrophoresis. See, e.g., Sambrook, Fritsch and Maniatis, Molecular Cloning: Cold Spring Harbor Laboratory Press (1989); Antibody Engineering Protocols (Methods in Molecular Biology), 510, Paul, S., Humana Pr (1996); Antibody Engineering: A Practical Approach (Practical Approach Series, 169), McCafferty, Ed., Irl Pr (1996); Antibodies: A Laboratory Manual, Harlow et al., CS.H.L. Press, Pub. (1999); and Current Protocols in Molecular Biology, eds. Ausubel et al., John Wiley & Sons (1992).

Example 1: FVIII-XTEN-Fc/D'D3-XTEN-Fc Heterodimers

The present invention is directed to generate a chimeric FVIII molecule which is coupled to D'D3 domain of von Willebrand Factor (VWF) protein via Fc domain of IgG. Attached D'D3 domain prevents the interaction of FVIII with endogenous VWF multimers. This molecule serves as a platform to incorporate other half-life extension technologies in order to improve the pharmacokinetics of the chimeric protein. XTEN sequences were incorporated into the FVIII B-domain and in between D'D3 and Fc region to increase the half-life of FVIII/VWF heterodimer Thrombin cleavage site in between D'D3 and Fc allows the release of D'D3 domain upon the activation of FVIII molecule by thrombin.

Example 2: Plasmid Construction of FVIII-XTEN-Fc/D'D3-Fc Heterodimers

Cloning of VWF050-IHH Triple Mutation in VWF031

IHH triple mutation in Fc prevents interaction with FcRn, thus there is no recycling of Fc containing molecule by FcRn pathway. The 3 mutations in Fc are I253A, H310A, H435A.

VWF050 was generated by swapping the Fc region of VWF031 plasmid with Fc fragment containing IHH triple mutation between the RsRII and Not 1 restriction sites. Cloning of VWF057-Cloning VWF-Fc with 144 AE XTEN+35aa thrombin cleavable linker.

Oligos

```
ESC 155-Oligo for 144 AE XTEN in VWF034-rev
CCCCGCCACCGGATCCCCCGCCACCGGATCCCCCGCCACCGGATCCCCC

GCCACCGGAACCTCCACCGCCGCTCGAGGCACCTTCTTCAGTGCTGGTGG

GCGAGCCCGCTGGTGACCCTTCCTC

ESC 156-Oligo for 144 AE XTEN-GS linker in
VWF034-rev
GGGGAAGAGGAAGACTGACGGTCCGCCCAGGAGTTCTGGAGCTGGGCAC

GGTGGGCATGTGTGAGTTTTGTCGCCTCCGCTGCCCCGGGGACCAGGG

ATCCCCCGCCACCGGATCCCCCGCCACCGGATCCCCCGCCACCGGATC

CCCCGCC

ESC 157-Oligo for 144 AE XTEN in VWF031-Fwd
GTGAAGCCTGCCAGGAGCCGATATCGGGCGCGCCAACATCAGAGAGCGC

CACCCCTGAAAGTGGTCCCGGGAGCGAGCCAGC
```

PCR was done twice to obtain the 144 AE-XTEN+35 aa GS linker with thrombin cleavage site.

First PCR reaction was done using 144-AE XTEN coding DNA as template and ESC 157/ESC155 primer pair. About 550 bp long PCR product obtained from this reaction was used as template for second PCR reaction and was amplified using ESC 157/156 primer pair. This reaction gave ~700 bp long product. This 700 bp PCR product and VWF034 plasmid was then digested with EcoRV-HF and RsRII. Plasmid backbone from digested.

VWF034 was then used to ligate 700 bp PCR product. Cloning of VWF058-IHH Triple Mutation in VWF034

IHH triple mutation in Fc prevents interaction with FcRn, thus there is no recycling of Fc containing molecule by FcRn pathway. The 3 mutations in Fc are I253A, H310A, H435A.

VWF058 was generated by swapping the Fc region of VWF034 plasmid with Fc fragment containing IHH triple mutation between the RsRII and Not 1 restriction sites.

Cloning of FVIII-263-FVIII 205 with IHH Triple Mutation

IHH triple mutation in Fc prevents interaction with FcRn, thus there is no recycling of Fc containing molecule by FcRn pathway. The 3 mutations in Fc are I253A, H310A, H435A.

FVIII-263 was generated by swapping the Fc region of FVIII 205 plasmid with Fc fragment containing IHH triple mutation between the RsRII and Not 1 restriction sites.

Cloning of FVIII-282-FVIII-Fc with 144 AE XTEN in B-Domain

```
ESC 158-Oligo for 144 AE XTEN in B-domain-fwd
AAGAAGCTTCTCTCAAAACGGCGCGCCAACATCAGAGAGCGCCACCCCTG

AAAGTGGTCCCGGGAGCGAGCCAGCCACATCTGGGTCGGAAACGCCAGGC

ESC 159-Oligo for 144 AE XTEN in B-domain-rev
GGTATCATCATAATCGATTTCCTCTTGATCTGACTGAAGAGTAGTACGAG

TTATTTCAGCTTGATGGCGTTTCAAGACTGGTGGGCTCGAGGCACCTTCT

TCAGTGCTGGTGGGCGAGCCCGCTGGTGACCCTTCCTCAGTGGACGTAGG
```

First PCR reaction was done using 144-AE XTEN coding DNA as template and ESC 158/ESC159 primer pair. About 550 bp long PCR product obtained from this reaction and FVIII 169 plasmid was then digested with AscI and Cla1. Plasmid backbone from digested FVIII 169 was then used to ligate 550 bp PCR product in order to obtain FVIII 282.

Cloning of FVIII-283-FVIII 169 with IHH Triple Mutation

IHH triple mutation in Fc prevents interaction with FcRn, thus there is no recycling of Fc containing molecule by FcRn pathway. The 3 mutations in Fc are I253A, H310A, H435A.

FVIII-283 was generated by swapping the Fc region of FVIII 169 plasmid with Fc fragment containing IHH triple mutation between the RsRII and Not 1 restriction sites.

Example 3: Production of FVIII-XTEN-Fc/D'D3-XTEN-Fc in HEK293 Cells

FIG. 2. Schematic diagram showing the expression of FVIII-XTEN-Fc/D'D3-XTEN-Fc construct. Three plasmids co-transfection was done in HEK293 cells using Polyethylenimine (PEI). First plasmid derives the expression of FVIII-XTEN-Fc, second plasmid expresses D1D2D'D3-XTEN-Fc and the third plasmid expression PACE/furin, which is required to enzymatically remove propeptide, i.e., D1D2 domain from D1D2D'D3-XTEN-Fc. Products of this three plasmid expression system includes of FVIII-XTEN-Fc/D'D3-XTEN-Fc heterodimer, D'D3-XTEN-Fc homodimer and traces of FVIII-XTEN-Fc hemizygous looking species.

Example 4: Purification of FVIII-XTEN-Fc/D'D3-XTEN-Fc Heterodimers

To purify the FVIII-XTEN-Fc/D'D3-XTEN-Fc heterodimers, a tangential flow filtration (TFF) step was used to first concentrate the conditioned media by 10 fold. Products in the filtrate were then further purified using affinity chromatography follow by a desalting column. Purity of the molecule was acceptable by HPLC-SEC and was further confirmed by western blotting. The specific activity of the molecule was comparable to B-domain deleted FVIII, as measured by FVIII activity assay (example 5) and OD280 measurement.

Example 5: Specific Activity of FVIII-XTEN-Fc/D'D3-XTEN-Fc Heterodimers

The activity of FVIII-XTEN-Fc/D'D3-XTEN-Fc heterodimers was measure by FVIII chromogenic assay and activated Partial Thromboplastin Time (aPTT) assay. The specific chromogenic activity and specific aPTT activity of SQ BDD-FVIII, rFVIII169/VWF034 and rFVIII169/VWF057 were listed in Table 16. Compared to SQ BDD-FVIII, we have observed comparable specific chromogenic activities and 60% reduction on the specific aPTT activity for rFVIII169/VWF034 and rFVIII169/VWF057.

TABLE 16

Specific activity of heterodimer variants

| FVIII | SQ BDD-FVIII | rFVIII169/VWF034 | rFVIII160/VWF057 |
|---|---|---|---|
| Specific Chromogenic Activity (IU/pmol) | 0.9-2.0 | 1.1-1.2 | 0.8-1.6 |
| Specific aPTT Activity (IU/pmol) | 0.75-1.7 | 0.4 | 0.3-0.6 |

FVIII Chromogenic Assay

The FVIII activity was measured using the COATEST SP FVIII kit from DiaPharma (produce #: K824086) and all incubations were performed on a 37° C. plate heater with shaking.

The WHO 8th International Standard for Blood Coagulation Factor VIII:C, Concentrate, coded 07/350 was used as assay standard, the range of the standard was from 100 mIU/mL to 0.78 mIU/mL. A pooled normal human plasma assay control and testing samples (diluted with 1× Coatest buffer) were added into Immulon 2HB 96-well plates in duplicate (25 µL/well). Freshly prepared IXa/FX/Phospholipid mix (50 µL), 25 µL of 25 mM CaCl$_2$, and 50 µL of FXa substrate were added sequentially into each well with 5 minutes incubation between each addition. After incubating with the substrate, 25 µL, of 20% Acetic Acid was added to terminate the color reaction, and the absorbance of OD405 was measured with a SpectraMAX plus (Molecular Devices) instrument. Data were analyzed with SoftMax Pro software (version 5.2). The Lowest Level of Quantification (LLOQ) is 7.8 mIU/mL.

FVIII aPTT Assay

The FVIII aPTT assay was performed on the Sysmex CA-1500 coagulation analyzer as follows: First, 50 uL of manually diluted samples, standards and Controls in aPTT buffer (50 mM Tris, 100 mM NaCl, 1% HSA, pH 7.4) were added by the instrument into the reaction cuvette, followed by adding 50 uL of FVIII-deficient plasma (George King Bio-Medical, product #: 0800). Following incubation at 37° C. for 1 minute, 50 uL of aPTT reagent (Actin® FSL activated cephaloplastin reagent—Dade Behring, reference # B4219-2) was added to the reaction mixture, and incubated at 37° C. for 4 minutes. Subsequently, 50 ul of 20 mM CaCl$_2$ (Dade Behring, reference # ORF037) was added, and the reaction cuvette was immediately transferred to one of four spectrophotometer channel positions to measure the amount of refracted light in the mixture, which was converted to the onset of clotting by the instrument's software algorithm. Reported clotting time was the length of time from the addition of CaCl$_2$ until the onset of clot formation. Assay standard was generated by diluting the WHO 8th International FVIII Standard into aPTT buffer in a range from 100 mIU/ml to 0.78 mIU/ml. The standard curve was plotted as the clotting time (in seconds) as Y-axis versus the log (base 10) of the FVIII activity (mIU/mL) as X-axis in MS Excel, and the activity of the individual samples was calculated using the formula for the linear regression line of this standard curve. Based on the assay performance, the lower limit of quantization (LLOQ) was 7.8 mIU/mL.

Example 6: Additive Effect of XTEN Insertions on the Half-Life Extension of Heterodimer XTEN insertions were incorporated into the heterodimers for half-life extension. Insertion of a single 288 amino acid (aa) AE-XTEN at FVIII B-domain resulted in a 16.7 hrs half-life of the heterodimer in HemA mice, as demonstrated by rFVIII169/VWF031 in FIG. 3. To further improve the half-life of the heterodimer, a second XTEN insertion at 144 aa or 288 aa length was incorporated into FVIII169/VWF031 either in the FVIII A1 domain or immediate down stream of D'D3 fragment respectively, the heterodimer variants were named as FVIII205/VWF031 and FVIII169/VWF034.

The half-life of rFVIII169NWF031, rFVIII205/VWF031 and rFVIII169/VWF034 were evaluated in FVIII deficient (HemA) mice by a single intravenous administration of test molecules at 200 IU/kg dose. Plasma samples were collected at designate time points as indicated in FIG. 3, the FVIII activity of the samples were determined by FVIII chromogenic assay, the PK parameters were calculated using WinNonlin-Phoenix program and listed in Table 17.

As shown in FIG. 3 and Table 17, the addition of the second XTEN insertion either at A1 domain of FVIII or down stream of D'D3 further improves the half-life of heterodimer to 29.45 or 31.10 respectively. Furthermore, more than 2-fold improvements on clearance and AUC were also observed from both XTEN insertions.

TABLE 17

PK parameter of heterodimers in HemA mice

| FVIII | XTEN Insertions Insertion 1 | XTEN Insertions Insertion 2 | $T_{1/2}$ (hr) | MRT (hr) | Cl (mL/hr/kg) | Vss (mL/kg) | AUC_D (kg*hr/mL) |
|---|---|---|---|---|---|---|---|
| rFVIII169/VWF031 | B*-AE288 |  | 16.65 | 18.44 | 3.57 | 85.72 | 0.28 |
| rFVIII205/VWF031 | B*-AE288 | A1-AE144 | 29.45 | 36.02 | 1.76 | 63.56 | 0.57 |
| rFVIII169/VWF034 | B*-AE288 | D'D3-AE288 | 31.10 | 34.57 | 1.73 | 59.77 | 0.58 |

Example 7: 144 aa AE-XTEN Confers Better Half-Life Benefit then 288 Aa AE-XTEN when Inserted in Between D'D3 and Fc Domains Another heterodimer-FVIII169/VWF057 was constructed in the effort of identifying the optimal length of XTEN insertion within the D'D3-XTEN-Fc chain, in which the length of XTEN insertion was reduced to 144aa from 288aa. As shown in FIG. 4, compared to rFVIII169/VWF034, the half-life of rFVIII169/VWF057 was increased from 31 hrs to 42 hrs. Improved clearance and AUC were also observed for rFVIII169/VWF057, data was listed in Table 18. Thus, 144aa AE-XTEN insertion is more optimal than AE-288aa XTEN when inserted between D'D3 and Fc domain of the FVIII-XTEN-Fc/D'D3-XTEN-Fc heterodimers.

TABLE 18

PK parameters of rFVIII169/VWF034 and rFVIII169/VWF057 in HemA mice

| FVIII | T$_{1/2}$ (hr) | MRT (hr) | Cl (mL/hr/kg) | Vss (mL/kg) | AUC_D (kg * hr/mL) |
|---|---|---|---|---|---|
| rFVIII169/VWF034 | 31.10 | 34.57 | 1.73 | 59.77 | 0.58 |
| rFVIII169/VWF057 | 42.23 | 53.24 | 0.97 | 51.44 | 1.03 |

Example 8: Fc Domain Extents the Half-Life of Heterodimer

Fc domains extent its fusion protein's half-life through FcRn mediated recycling pathway. To confirm the necessity of the Fc domain on the half-life extension of the heterodimer, the wild-type Fc domains were replaced by a triple mutant (I253A/H310A/H435A; IHH) in rFVIII205NWF031 to form rFVIII263/VWF050, and complete elimination of FcRn binding was confirmed by Surface Plasmon Resonance (Biacore) assay for rFVIII263/VWF050. The half-life of FVIII263NWF050 was evaluated in HemA mice in comparison with rFVIII205/VWF031. Increased clearance rate, as well as reduced half-life and AUC were observed for rFVIII263NWF050 as shown in FIG. 5 and Table 19. This result demonstrated that in addition to ensure the covalent binding of FVIII and D'D3, the Fc domains is also necessary for the half-life improvement of the heterodimer

TABLE 19

PK parameters of rFVIII205/VWF031 and rFVIII263/VWF040 in HemA mice

| FVIII | Mutation in Fc domain | T$_{1/2}$ (hr) | MRT (hr) | Cl (mL/hr/kg) | Vss (mL/kg) | AUC_D (kg*hr/mL) |
|---|---|---|---|---|---|---|
| rFVIII205/VWF031 | None | 29.45 | 36.02 | 1.76 | 63.56 | 0.57 |
| rFVIII263/VWF050 | IHH | 22.96 | 26.15 | 2.36 | 61.69 | 0.42 |

Example 9: Acute Efficacy of FVIII-XTEN-Fc/D'D3-XTEN-Fc Heterodimers in HemA Mouse Tail Clip Bleeding Model The acute efficacy of lead heterodimer candidates were evaluated using HemA mouse tail clip bleeding model.

8-12 weeks old male HemA mice were randomized into 4 treatment groups, and treated with a single intravenous administration of SQ BDD-FVIII, rFVIII169/VWF034, rFVIII169/VWF057 or vehicle solution respectively. In order to mimic the episodic treatment of FVIII (to reconstitute 50-100% of normal FVIII plasma level), the selected FVIII treatment dose is 75 IU/kg as measured by FVIII aPTT activity. At this dose level, all testing FVIII variants will reconstitute ~70% of normal murine plasma FVIII activity 5 min post dosing.

Figure 6:
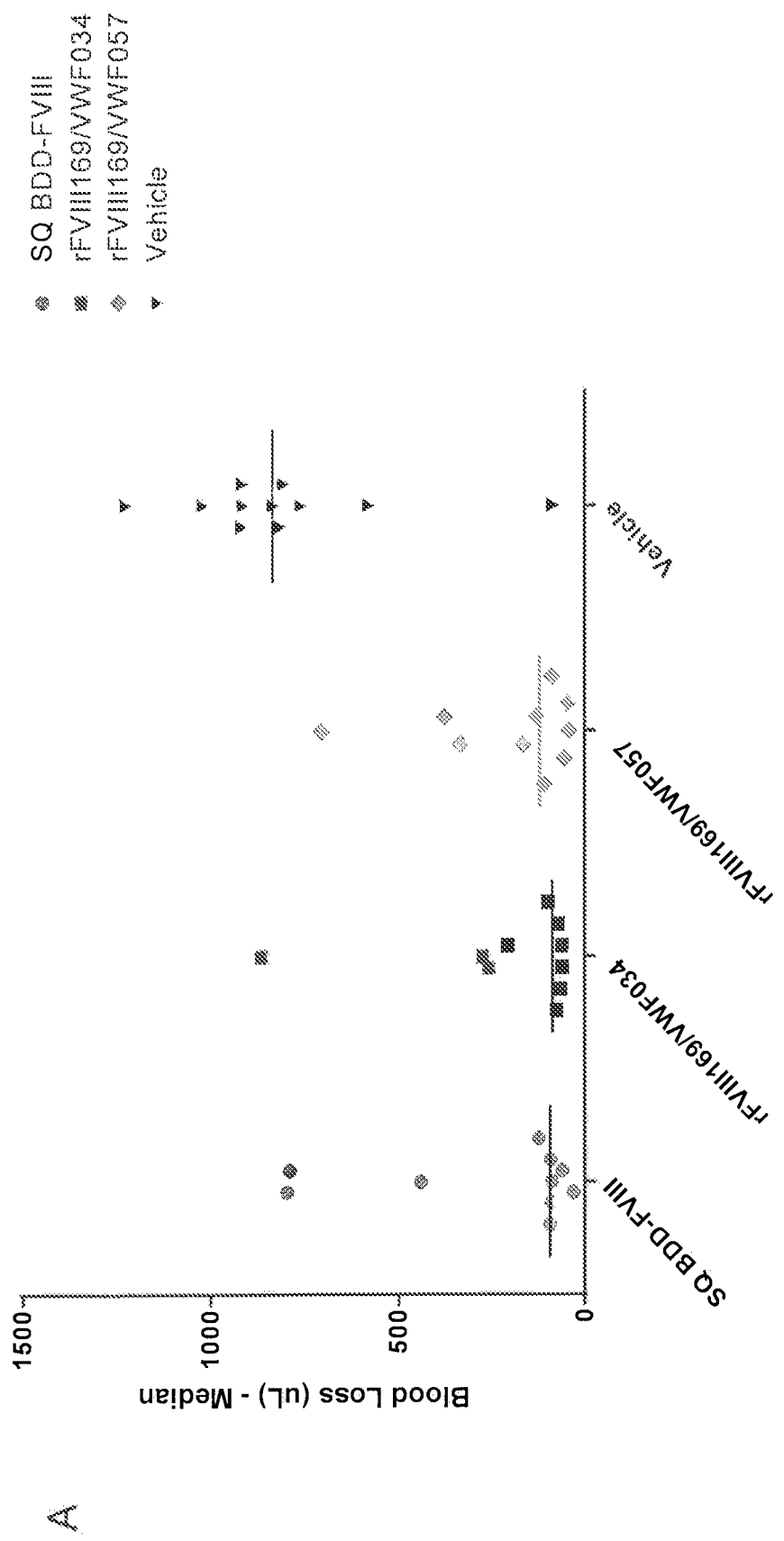
Figure 6:
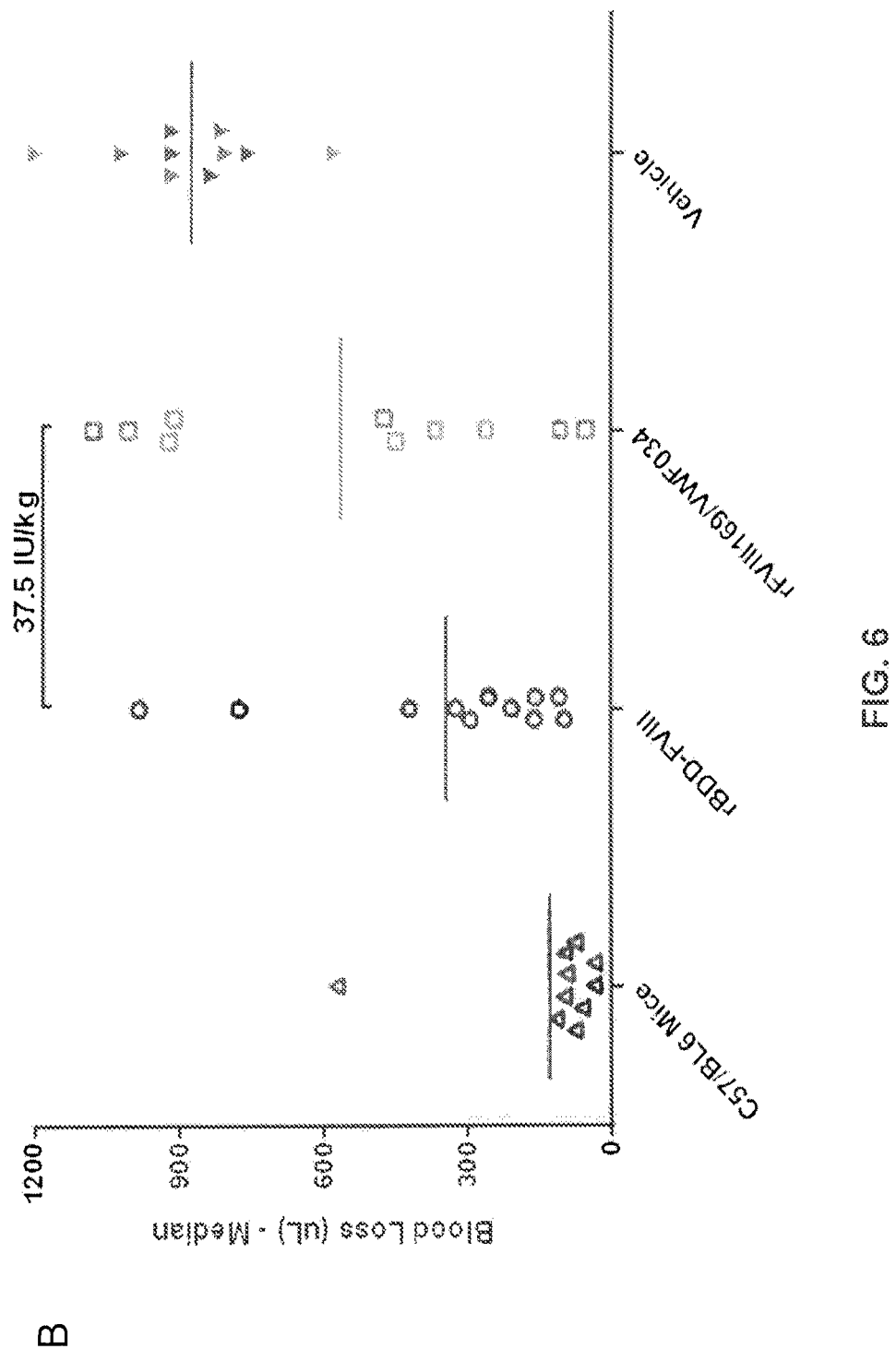

Blood loss volume from each individual animal in the study was plotted in FIG. 6. Significant reduction on blood loss volume was observed for all FVIII treatment groups compared to vehicle treated animals. Within the three FVIII treatment groups, no statistical significant different were found on blood loss reduction, suggesting the heterodimer molecules could potentially as efficacious as SQ BDD-FVIII for on demand treatment.

Blood loss volume from each individual animal in the study was plotted in FIG. 6. Significant reduction on blood loss volume was observed for all FVIII treatment groups compared to vehicle treated animals. Within the three FVIII treatment groups, no statistical significant different were found on blood loss reduction, suggesting the heterodimer molecules could potentially as efficacious as SQ BDD-FVIII for on demand treatment.

In addition, HemA mice were treated with a lower dose (37.5 IU/kg) of rBDD-FVIII or rFVIII169/VWF034, and the results are shown in FIG. 6B. Same as the 75 IU/kg dose, rFVIII169NWF034 provided similar protection as BDD-FVIII to HemA mice post tail clip injury, indicating the molecule was still efficacious to treat severe bleeding episodes at ~35% of normal murine circulating FVIII level in HemA mice.

The Tail Clip procedure was carried out as follows. Briefly, mice were anesthetized with a 50 mg/kg Ketamine/0.5 mg/kg Dexmedetomidine cocktail prior to tail injury and placed on a 37° C. heating pad to help maintain the body temperature. The tails of the mice were then be immersed in 37'C saline for 10 minutes to dilate the lateral vein. After vein dilation, FVIII variants or vehicle solution were injected via the tail vein and the distal 5 mm of the tail was then cut off using a straight edged #11 scalpel 5 min post dosing. The shed blood was collected into 13 ml of 37'C saline for 30 minutes and blood loss volume was determined by the weight change of the blood collection tube: blood loss volume=(collection tube end weight−beginning weight+ 0.10) ml. Statistical analysis were conducted using t test (Mann Whitney test) and one way ANOVA (KRUSKAL-Wallis test, posttest: Dunns multiple comparison test).

Example 10: Prophylactic Efficacy of FVIII-XTEN-Fc/D'D3-XTEN-Fc Heterodimer in HemA Mouse Tail Vein Transection Bleeding Model The prophylactic efficacy of FVIII169/VWF057 was tested in HemA mouse tail vein transection (TVT) model. The TVT model induces bleeding by introducing injury to the lateral vein of the mouse tail, which mimics the spontaneous bleeding episodes in patients with hemophilia bleeding disorder.

8-10 weeks old male HemA mice were randomized into four treatment groups, and treated with either FVIII169/VWF057 at 72 hr prior of the tail vein injury, or SQ BDD-FVIII at 24 hr or 48 hr before the injury. Vehicle treated animal were used as negative control. Events of re-bleeding or euthanasia due to the excessive blood loss within 24 hrs post injury were plotted in FIG. 7.

Figure 7:
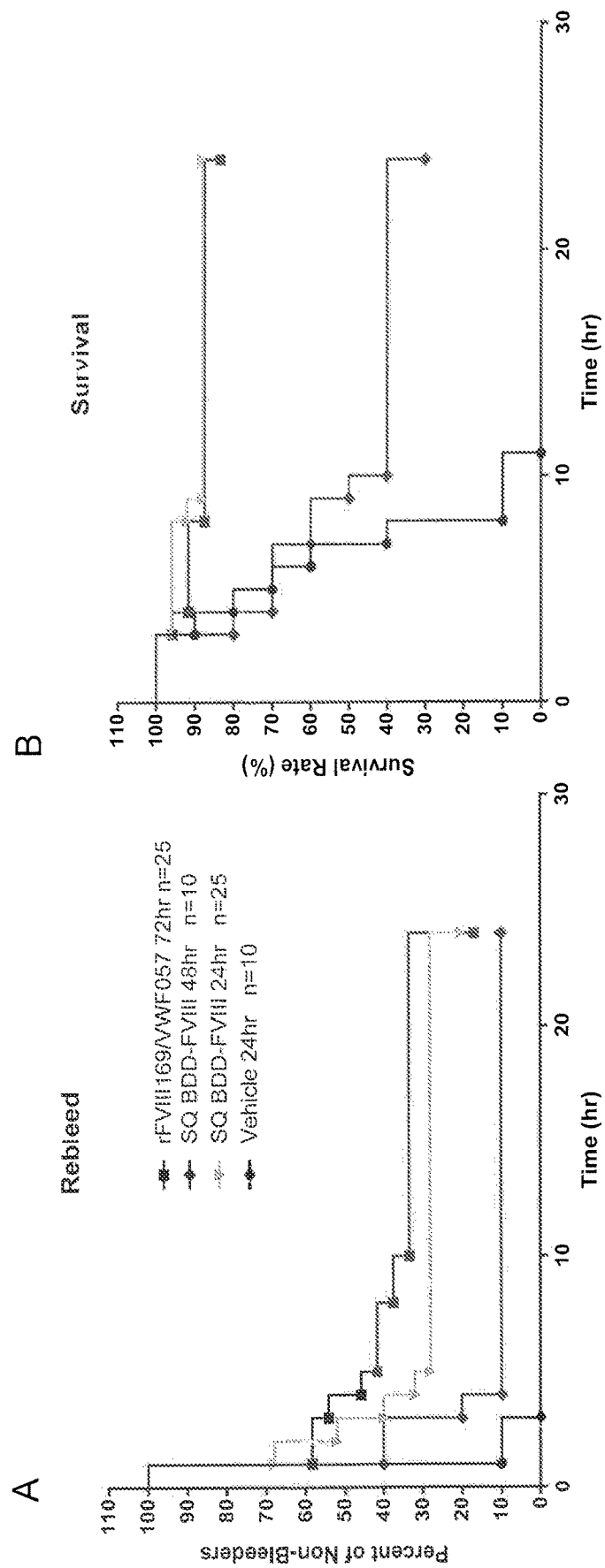

As shown in FIG. 7, unlike mice treated with SQ BDD-FVIII at 48 hr prior to TVT, of whom only limited protection was observed post injury, mice that received rFVIII169NWF057 at 72 hr prior the tail injury had similar protection on re-bleeding and survival compared to the mice that received SQ BDD-FVIII treatment 24 hr before TVT, indicating rFVIII169/VWF057 can provide at least 3-fold or more (e.g., 4-fold) longer-protection to HemA mice in TVT model. Therefor rFVIII169NWF057 might significantly reduce the treatment frequency of the current FVIII prophylaxis.

Similarly, HemA mice were treated with FVIII-XTEN-Fc/D'D3-XTEN-Fc heterodimers: rFVIII169/VWF034 and rFVIII169/VWF057. at 24 or 96 hours prior to the tail vein injury. The rebleeding and survival data of the treatments were compared with the data by the rBDD-FVIII at 24 or 48 hour prior to the injury and vehicle. While the rebleeding in mice treated with rBDD-FVIII at 24 hours prior to the tail vein injury was similar to the mice treated with vehicle, the rebleeding data of mice treated with the heterodimers at 24 hr before the injury are significantly better than the vehicle treatment group. Furthermore, the rebleeding data of mice treated with the heterodimers at 96 hr before the injury were comparable to mice received rBDD-FVIII at 24 hr before the injury. As for the survival rate at 24 hr post the TVT injury, in contrast of the less than 50% survival rate of mice treated with rBDD-FVIII, more than 90% of the mice survived the TVT injury with FVIII-XTEN-Fc/D'D3-XTEN-Fc heterodimers treatment when FVIII molecules were administered at 24 hr before the injury. In addition, the survival in mice treated with the FVIII-XTEN-Fc/D'D3-XTEN-Fc heterodimers at 96 hours prior to the tail vein injury were better (in the case of rFVIII169/VWF034) or comparable (in the case of rFVIII169/VWF057) when compared with the mice that received rBDD-FVIII treatment at 24 hours prior to the injury. Both rebleeding and survival data had indicated a 4-fold efficacy prolongation of FVIII-XTEN-Fc/D'D3-XTEN-Fc heterodimer treatment vs. rBDD-FVIII treatment.

HemA Mouse Tail Vein Transection Model

The tail vein transection procedure was conducted as follows. Mice were anesthetized with a cocktail containing 50 mg/kg of Ketamine, 0.125 mg/kg of Dexmedetomidine, and 0.1 mg/kg of Buprenex. At an adequate anesthetic depth, the lateral tail vein of the mice was transected with straight edged number 11 surgical blade at an area where the diameter of the tail is approximately 2.7 mm. The shedding blood was washed away with warm saline to ensure clear observation of the wound. The treated mice were then single housed in a clean cage with white paper bedding for the next 24 hours. Tail re-bleed and the mouse's physical activity were observed and recorded hourly up to 12 hour post tail injury. Moribund mice were euthanized immediately, and a final observation was performed at 24 hour post tail injury. To mimic the bleeding situation in hemophilia patients and to ensure the animal's completely recovery from anesthesia, 1 mg/kg of Atipamezole solution was given to reverse Dexmedetomidine effect at the beginning of the Tail Vein Transection. An additional dose of 0.1 mg/kg Buprenex was administered at the end of the 12 hour observation period for overnight pain management. The survival curve of Time to Re-bleed and Time to Euthanasia was generated for data analysis, and Log-rank (Mantel-COX) test was used for statistic evaluation.

Example 11: Preparation of FVIII169/VWF059 and Other Constructs pSYN FVIII 310 Cloning:

A synthetic DNA fragment flanked with BamH1 site at the N-terminus and Cla 1 site at the C-terminus was commercially made. This synthetic DNA was used to replace the BamH1 to Cla 1 region in pSYN FVIII 169 construct (SEQ ID NO: 155). Both synthetic DNA and pSYN FVIII 169 DNA were double digested with BamH1 and Cla1, digested synthetic DNA was inserted into digested pSYN FVIII 169 to create pSYN FVIII 310 (SEQ ID NO:168; Table 20).

Cloning pSYN FVIII 312:

A synthetic DNA fragment flanked with BamH1 site at the N-terminus and Afe 1 site at the C-terminus was commercially made. This synthetic DNA was used to replace the BamH1 to Afe1 region in pSYN FVIII 169 construct (SEQ ID NO: 155). Both synthetic DNA and pSYN FVIII 169 DNA were double digested with BamH1 and Afe1, digested synthetic DNA was inserted into digested pSYN FVIII 169 to create pSYN FVIII 312 (SEQ ID NO: 169; Table 20). pSYN FVIII 312A (SEQ ID NO: 2; Table 20) was created from pSYN FVIII312 to remove AscI site which codes for amino acid residues GAP at the junction of FVIII and XTEN.

TABLE 20

Synthetic FVIII constructs.

| Construct | Protein Sequence |
| --- | --- |
| pSYN FVIII 169 | PRSFSQNGAPGTSESATPESGPGSEPATSGSETPGTSESATPESGPGSEPATSGS ETPGTSESATPESGPGTSTEPSEGSAPGSPAGSPTSTEEGTSESATPESGPGSEP ATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPG TSESATPESGPGTSTEPSEGSAPASSPPVLKRHQAEITR (SEQ ID NO: 167)<br>(Underlined = XTEN residues; not underlined = FVIII residues) |
| pSYN FVIII 310 | PRSFGAPGTSESATPESGPGSEPATSGSETPGTSESATPESGPGSEPATSGSETP GTSESATPESGPGTSTEPSEGSAPGSPAGSPTSTEEGTSESATPESGPGSEPATS GSETPGTSESATPESGPGSPAGSPTSTEEGSPAGSPTSTEEGTSTEPSEGSAPGT SESATPESGPGTSESATPESGPGTSESATPESGPGSEPATSGSETPGSEPATSGS ETPGSPAGSPTSTEEGTSTEPSEGSAPGTSTEPSEGSAPGSEPATSGSETPGTSE SATPESGPGTSTEPSEGSAPASSEITR (SEQ ID NO: 168)<br>(Underlined = XTEN residues; not underlined = FVIII residues) |
| pSYN FVIII 312 | PRSFSQNGAPGTSESATPESGPGSEPATSGSETPGTSESATPESGPGSEPATSGS ETPGTSESATPESGPGTSTEPSEGSAPGSPAGSPTSTEEGTSESATPESGPGSEP ATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPG TSESATPESGPGTSTEPSEGSAPASSEITR (SEQ ID NO: 169)<br>(Underlined = XTEN residues; not underlined = FVIII residues) |

TABLE 20-continued

Synthetic FVIII constructs.

| Construct | Protein Sequence |
|---|---|
| pSYN FVIII 312A | PRSFSQNGTSESATPESGPGSEPATSGSETPGTSESATPESGPGSEPATSGSETP<br>GTSESATPESGPGTSTEPSEGSAPGSPAGSPTSTEEGTSESATPESGPGSEPATS<br>GSETPGTSESATPESGPGSPAGSPTSTEEGSPAGSPTSTEEGTSTEPSEGSAPGT<br>SESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSE<br>SATPESGPGTSTEPSEGSAPASSEITR (SEQ ID NO: 2)<br>(similar sequence as pSYNFVIII312 just residues corresponding<br>to AscI site i.e GAP are removed) (Underlined = XTEN<br>residues; not underlined = FVIII residues) |

Cloning pSYN VWF059 and VWF073:

Various synthetic DNA fragments coding for different linker regions between D'D3-XTEN and Fc were made. These synthetic DNA fragments were flanked with Asc1 site at N-terminus and Not 1 site at the C-terminus. These synthetic DNAs were used to replace the Asc1 to Not1 region in pSYN VWF057 construct (SEQ ID NO: 152). The pSYN VWF059 construct (Table 21) comprises a linker region (SEQ ID NO: 13), which includes the entire FVIII acidic region 2 (a2). This site is reported to be cleaved by thrombin, and upon FVIII activation D'D3XTEN is released. The pSYN VWF073 construct (Table 21) contains only the thrombin cleavage site of FVIII acidic region 2 (a2) (i.e., IEPRSFS) (SEQ ID NO: 23). Both synthetic DNA and pSYN VWF057 DNA were double digested with Asc1 and Not1. Digested synthetic DNA was inserted into digested pSYN VWF057 to create pSYN VWF059 and pSYN VWF073. The pSYN VWF59A construct (Table 21) was generated from pSYN VWF059 by removing the EcoRV restriction site. FVIII169/VWF057 and FVIII169/VWF059 heterodimer proteins were generated by co-expression of FVIII169 and VWF057 or VWF059 in HEK293 cells.

experiment were FVIII169NWF057 heterodimer and FVIII169/VWF059 heterodimer along with FVIIIFc. The FVIII169NWF057 and FVIII169NWF059 heterodimers are described above. Three digestion reactions were carried out: i) FVIIIFc ii) FVIII169/VWF057 (FIG. 11), and iii) FVIII 169/VWF059 (FIG. 12). Test samples were treated with human α-thrombin at a molar ratio if FVIII:thrombin of approximately 22:1. Each reaction was incubated in a 37° C. water bath. At each indicated time point (t=5, 15, 30, 45, 60 minutes), a 22.5 μL sample was withdrawn, stopped with 22.5 μL non-reducing 2x SDS loading dye, and heated for 3 minutes. The digested protein was then run on an SDS-PAGE gel. Western blotting was performed using anti-FVIII heavy chain (GMA012) and anti-VWF-D3 (Ab96340) antibodies using a LICOR system.

Figure 11:
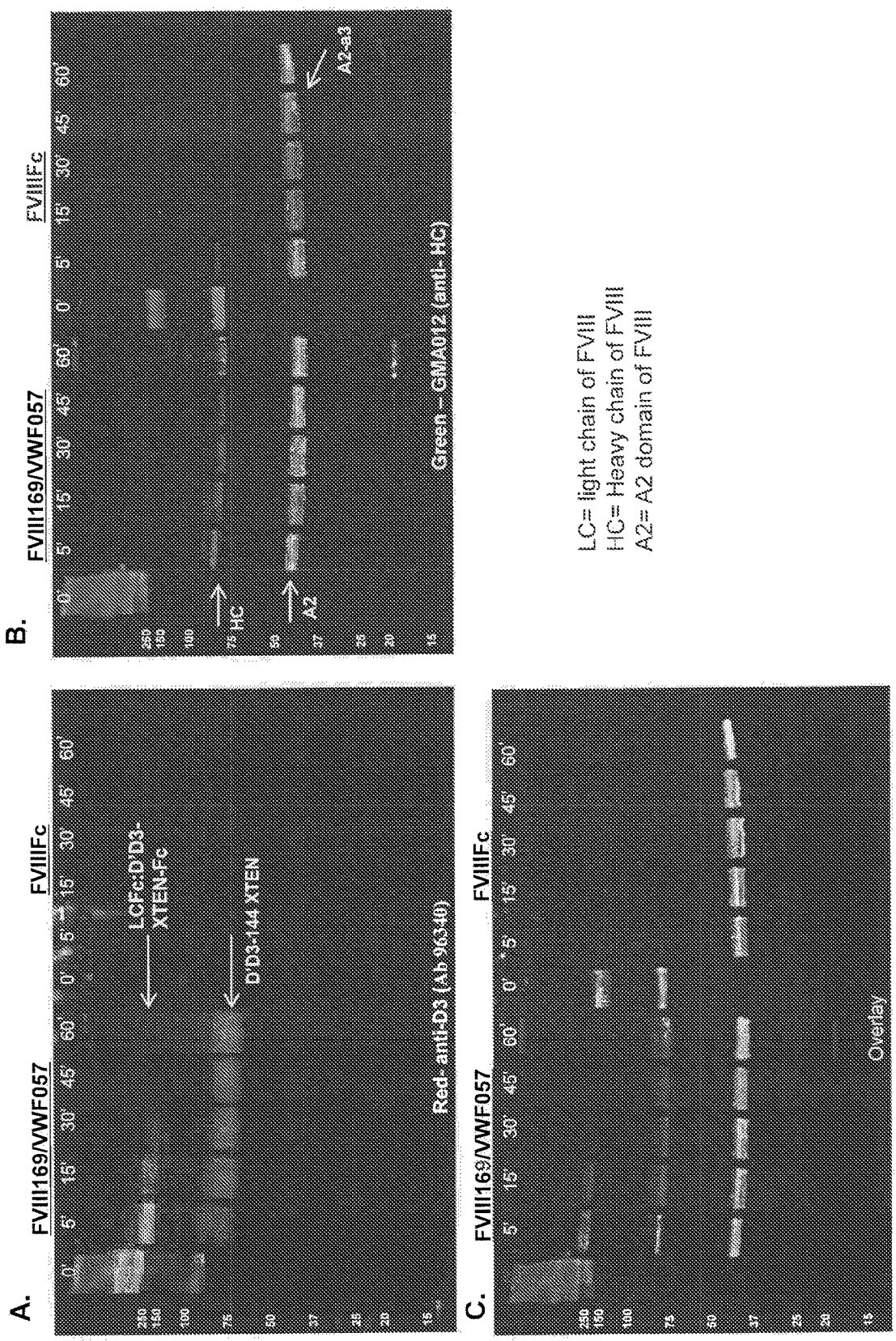

As shown in FIG. 11, exposure of FVIII169/VWF057 to thrombin resulted in a gradual decrease in the detected level of D'D3-XTEN-Fc, correlating with an increase in the level of D'D3-144 XTEN, the cleaved product. Un-cleaved

TABLE 21

Synthetic VWF constructs - Cleavable Linker Regions.

| Construct | Protein Sequence |
|---|---|
| pSYN VWF057 | TSTEEGASS*GGGGSGGGGSGGGGSGGGGSGGGGSGGGGSGGGGSLVPRGSGG*DKTH (SEQ ID NO: 12)<br>Italics and underlined sequence shows GS linker and LVPR thrombin cleavage site (also bold). |
| pSYN VWF059 | TSTEEGASIS*DKNTGDYYEDSYEDISAYLLSKNNAIEPRSFSDKTH (SEQ ID NO: 13)<br>Italics and underlined sequence shows 32 aa from FVIII acidic region 2 (a2). Bold sequence shows thrombin cleavage site used in pSYN VWF059A. |
| pSYN VWF059A | TSTEEGASS*DKNTGDYYEDSYEDISAYLLSKNNAIEPRSFS*DKTH (SEQ ID NO: 22)<br>Italics and underlined sequence shows 32 aa from FVIII acidic region 2 (a2). This sequence is similar sequence to VWF059, except that residues corresponding to the EcoRV site (i.e., IS) are removed. |
| pSYN VWF073 | TSTEEGASS*GGGGSGGGGSGGGGSGGGGSGGGGSGGGGSGGGGSIEPRSFSGSGG*DKTH (SEQ ID NO: 23)<br>Italics and underlined sequence shows GS linker with truncated thrombin cleavage site from FVIII acidic region 2 (bold 7 amino acids-IEPRSFS). |

Example 12: Thrombin Digestion of FVIII Heterodimer to Analyze the Release of D'D3 from Fc Two FVIII heterodimer proteins were tested in thrombin digestion experiments and their rate of cleavage by thrombin was examined. The two heterodimer constructs used in this FVIII169/VWF057 remained after 15 minutes. Conversely, FIG. 12 shows that FVIII 169/VWF059 is cleaved more rapidly by thrombin, as evidenced by little to no detectable un-cleaved FVIII 169/VWF059 after 5 minutes. Accordingly, FVIII 169/VWF059 showed better release of D'D3 from Fc upon thrombin activation as compared or FVIII169/VWF057.

Parallel experiments were done to investigate thrombin cleavage using mass spectroscopy (MS). By MS, FVIII 169NWF059 again showed better release of D'D3 from Fc as compared to VWF057.

Example 13: In Vivo Evaluation of FVIII169/VWF059 in HemA Mice

To further evaluate the pharmacokinetic profile and in vivo potency of FVIII169/VWF059, HemA mice were treated with FVIII169/VWF059 through intravenous administration at 150 IU/kg dose. Plasma samples were collected via vena cava blood collection at 5 minutes, 24, 48, 72, 96 and 120 hours post injection. FVIII activity in plasma samples were measured by FVIII chromogenic assay and PK parameters were calculated using Phoenix program. A similar PK profile of FVIII169/VWF059 was observed in comparison with FVIII169/VWF057, as shown in Table 22, indicating that the a2 thrombin cleavage linker has no negative effect on the PK profile of the heterodimer

TABLE 22

PK profile of FVIII169/VWF057 and FVIII169/VWF059 in HemA mice

| Heterodimer | $T_{1/2}$ (hr) | AUC/D (hr * kg * mIU/mL/mIU) | Cl (mL/hr/kg) | MRT (hr) | Vss (mL/kg) |
|---|---|---|---|---|---|
| FVIII169/VWF057 | 38.53 | 0.80 | 1.26 | 44.92 | 56.38 |
| FVIII169/VWF059 | 40.51 | 0.74 | 1.35 | 49.22 | 66.26 |

The acute efficacy of FVIII169NWF059 was evaluated in a HemA mouse tail clip model (described in Example 9) in comparison with wild type BDD-FVIII. HemA mice were treated with 75 IU/kg of either FVIII169/VWF059 or BDD-FVIII, and blood loss volume of each experimental mouse was plotted in FIG. 13. Compared to BDD-FVIII, FVIII169/VWF059 provided the same degree of protection to HemA mice (p=0.9883), indicating that FVIII169/VWF059 is fully functional in vivo.

Plasmid Construction of FVIII-XTEN-Fc/D'D3-Fc Heterodimers

VWF031 Nucleotide Sequence (SEQ ID NO: 147)

```
   1 ATGAT TCCTG CCAGA TTTGC CGGGG TGCTG CTTGC TCTGG CCCTC ATTTT

51 GCCAG GGACC CTTTG TGCAG AAGGA ACTCG CGGCA GGTCA TCCAC GGCCC

101 GATGC AGCCT TTTCG GAAGT GACTT CGTCA ACACC TTTGA TGGGA GCATG

151 TACAG CTTTG CGGGA TACTG CAGTT ACCTC CTGGC AGGGG GCTGC AGAA

201 ACGCT CCTTC TCGAT TATTG GGGAC TTCCA GAATG CAAG AGAGT GAGCC

251 TCTCC GTGTA TCTTG GGGAA TTTTT TGACA TCCAT TTGTT TGTCA ATGGT

301 ACCGT GACAC AGGGG GACCA AAGAG TCTCC ATGCC CTATG CCTCC AAAGG

351 GCTGT ATCTA GAAAC TGAGG CTGGG TACTA CAAGC TGTCC GGTGA GGCCT

401 ATGGC TTTGT GGCCA GGATC GATGG CAGCG GCAAC TTTCA AGTCC TGCTG

451 TCAGA CAGAT ACTTC AACAA GACCT GCGGG CTGTG TGGCA ACTTT AACAT

501 CTTTG CTGAA GATGA CTTTA TGACC CAAGA AGGGA CCTTG ACCTC GGACC

551 CTTAT GACTT TGCCA ACTCA TGGGC TCTGA GCAGT GGAGA ACAGT GGTGT

601 GAACG GGCAT CTCCT CCCAG CAGCT CATGC AACAT CTCCT CTGGG GAAAT

651 GCAGA AGGGC CTGTG GGAGC AGTGC CAGCT TCTGA AGAGC ACCTC GGTGT

701 TTGCC CGCTG CCACC CTCTG GTGGA CCCCG AGCCT TTTGT GGCCC TGTGT

751 GAGAA GACTT GTGTG GAGTG TGCTG GGGGG CTGGA GTGCG CCTGC CCTGC

801 CCTCC TGGAG TACGC CCGGA CCTGT GCCCA GGAGG AATG GTGCT GTACG

851 GCTGG ACCGA CCACA GCGCG TGCAG CCCAG TGTGC CCTGC TGGTA TGGAG

901 TATAG GCAGT GTGTG TCCCC TTGCG CCAGG ACCTG CCAGA GCCTG CACAT

951 CAATG AAATG TGTCA GGAGC GATGC GTGGA TGGCT GCAGC TGCCC TGAGG

1001 GACAG CTCCT GGATG AAGGC CTCTG CGTGG AGAGC ACCGA GTGTC CCTGC

1051 GTGCA TTCCG GAAAG CGCTA CCCTC CCGGC ACCTC CCTCT CTCGA GACTG

1101 CAACA CCTGC ATTTG CCGAA ACAGC CAGTG GATCT GCAGC AATGA AGAAT

1151 GTCCA GGGGA GTGCC TTGTC ACTGG TCAAT CCCAC TTCAA GAGCT TTGAC

1201 AACAG ATACT TCACC TTCAG TGGGA TCTGC AGTA CCTGC TGGCC GGGA

1251 TTGCC AGGAC CACTC CTTCT CCATT GTCAT TGAGA CTGTC CAGTG TGCTG

1301 ATGAC CGCGA CGCTG TGTGC ACCCG CTCCG TCACC GTCCG GCTGC CTGGC
```

-continued

```
1351 CTGCA CAACA GCCTT GTGAA ACTGA AGCAT GGGGC AGGAG TTGCC ATGGA
1401 TGGCC AGGAC ATCCA GCTCC CCCTC CTGAA AGGTG ACCTC CGCAT CCAGC
1451 ATACA GTGAC GGCCT CCGTG CGCCT CAGCT ACGGG GAGGA CCTGC AGATG
1501 GACTG GGATG GCCGC GGGAG GCTGC TGGTG AAGCT GTCCC CCGTC TATGC
1551 CGGGA AGACC TGCGG CCTGT GTGGG AATTA CAATG GCAAC AGGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG GACCT GCAGA AGCAG CACAG
1701 CGATC CCTGC GCCCT CAACC CGCGC ATGAC CAGGT TCTCC GAGGA GGCGT
1751 GCGCG GTCCT GACGT CCCCC ACATT CGAGG CCTGC ATCCG TGCCG TCAGC
1801 CCGCT GCCCT ACCTG CGGAA CTGCC GCTAC GACGT GTGCT CCTGC TCGGA
1851 CGGCC GCGAG TGCCT GTGCG GCGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AAGGC CAGGT GTACC TGCAG TGCGG ACCCC CTGCA AACCT
2001 GACCT GCCGC TCTCT CTCTT ACCCG GATGA GGAAT GCAAT GAGGC CTGCC
2051 TGGAG GGCTG CTTCT GCCCC CCAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA ACGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC ATCA GGGCA
2501 AGGAG TATGC CCCTG GAGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG GCCTG TGTGG GAATT TTGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA ACATC
3151 ATGAA GCAGA CGATG GTGGA TTCCT CCTGT AGAAT CCTTA CCAGT GACGT
3201 CTTCC AGGAC TGCAA CAAGC TGGTG GACCC CGAGC ATATC TGGA TGTCT
3251 GCATT TACGA CACCT GCTCC TGTGA GTCCA TTGGG GACTG CGCCG CATTC
3301 TGCGA CACCA TTGCT GCCTA TGCCC ACGTG TGTGC CCAGC ATGGC AAGGT
```

-continued

```
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC TGGCG GTGGA GGTTC CGGTG GCGGG
3751 GGATC CGGCG GTGGA GGTTC CGGCG GTGGA GGTTC CGGTG GCGGG GGATC
3801 CGGTG GCGGG GGATC CCTGG TCCCC CGGGG CAGCG GCGGT GGAGG TTCCG
3851 GTGGC GGGGG ATCCG ACAAA ACTCA CACAT GCCCA CCGTG CCCAG CTCCA
3901 GAACT CCTGG GCGGA CCGTC AGTCT CCTCT TCCCC CCAA AACCC AAGGA
3951 CACCC TCATG ATCTC CCGGA CCCCT GAGGT CACAT GCGTG GTGGT GGACG
4001 TGAGC CACGA AGACC CTGAG GTCAA GTTCA ACTGG TACGT GGACG GCGTG
4051 GAGGT GCATA ATGCC AAGAC AAAGC CGCGG GAGGA GCAGT ACAAC AGCAC
4101 GTACC GTGTG GTCAG CGTCC TCACC GTCCT GCACC AGGAC TGGCT GAATG
4151 GCAAG GAGTA CAAGT GCAAG GTCTC CAACA AAGCC CTCCC AGCCC CCATC
4201 GAGAA AACCA TCTCC AAAGC CAAAG GGCAG CCCCG AGAAC CACAG GTGTA
4251 CACCC TGCCC CCATC CCGCG ATGAG CTGAC CAAGA ACCAG GTCAG CCTGA
4301 CCTGC CTGGT CAAAG GCTTC TATCC CAGCG ACATC GCCGT GGAGT GGGAG
4351 AGCAA TGGGC AGCCG GAGAA CAACT ACAAG ACCAC GCCTC CCGTG TTGGA
4401 CTCCG ACGGC TCCTT CTTCC TCTAC AGCAA GCTCA CCGTG GACAA GAGCA
4451 GGTGG CAGCA GGGGA ACGTC TTCTC ATGCT CCGTG ATGCA TGAGG CTCTG
4501 CACAA CCACT ACACG CAGAA GAGCC TCTCC CTGTC TCCGG GTAAA TGA
```

40
VWF031 Protein Sequence (SEQ ID NO: 86)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL ETEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
451 LHNSLVKLKH GAGVAMDGQD IQLPLLKGDL RIQHTVTASV RLSYGEDLQM
501 DWDGRGRLLV KLSPVYAGKT CGLCGNYNGN QGDDFLTPSG LAEPRVEDFG
551 NAWKLHGDCQ DLQKQHSDPC ALNPRMTRFS EEACAVLTSP TFEACHRAVS
601 PLPYLRNCRY DVCSCSDGRE CLCGALASYA AACAGRGVRV AWREPGRCEL
651 NCPKGQVYLQ CGTPCNLTCR SLSYPDEECN EACLEGCFCP PGLYMDERGD
701 CVPKAQCPCY YDGEIFQPED IFSDHHTMCY CEDGFMHCTM SGVPGSLLPD
```

```
 751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGGGGSGGG

1251 GSGGGGSGGG GSGGGGSGGG GSLVPRGSGG GGSGGGGSDK THTCPPCPAP

1301 ELLGGPSVFL FPPKPKDTLM ISRTPEVTCV VVDVSHEDPE VKFNWYVDGV

1351 EVHNAKTKPR EEQYNSTYRV VSVLTVLHQD WLNGKEYKCK VSNKALPAPI

1401 EKTISKAKGQ PREPQVYTLP PSRDELTKNQ VSLTCLVKGF YPSDIAVEWE

1451 SNGQPENNYK TTPPVLDSDG SFFLYSKLTV DKSRWQQGNV FSCSVMHEAL

1501 HNHYTQKSLS LSPGK*
```

VWF034 Nucleotide Sequence (SEQ ID NO: 148)

```
   1 ATGAT TCCTG CCAGA TTTGC CGGGG TGCTG CTTGC TCTGG CCCTC ATTTT

51 GCCAG GGACC CTTTG TGCAG AAGGA ACTCG CGGCA GGTCA TCCAC GGCCC

101 GATGC AGCCT TTTCG GAAGT GACTT CGTCA ACACC TTTGA TGGGA GCATG

151 TACAG CTTTG CGGGA TACTG CAGTT ACCTC CTGGC AGGGG CTGC CAGAA

201 ACGCT CCTTC TCGAT TATTG GGAC TTCCA GAATG GCAAG AGAGT GAGCC

251 TCTCC GTGTA TCTTG GGAA TTTTT TGACA TCCAT TGTT TGTCA ATGGT

301 ACCGT GACAC AGGGG GACCA AAGAG TCTCC ATGCC CTATG CCTCC AAAGG

351 GCTGT ATCTA GAAAC TGAGG CTGGG TACTA CAAGC TGTCC GGTGA GGCCT

401 ATGGC TTTGT GGCCA GGATC GATGG CAGCG GCAAC TTTCA GTCC TGCTG

451 TCAGA CAGAT ACTTC AACAA GACCT GCGGG CTGTG TGGCA ACTTT AACAT

501 CTTTG CTGAA GATGA CTTTA TGACC CAAGA AGGGA CCTTG ACCTC GGACC

551 CTTAT GACTT TGCCA ACTCA TGGGC TCTGA GCAGT GGAGA CAGT GGTGT

601 GAACG GCAT CTCCT CCCAG CAGCT CATGC AACAT CTCCT CTGGG AAAT

651 GCAGA AGGGC CTGTG GGAGC AGTGC CAGCT TCTGA GAGC ACCTC GGTGT

701 TTGCC CGCTG CCACC CTCTG GTGGA CCCCG AGCCT TTTGT GGCCC TGTGT

751 GAGAA GACTT TGTGT GAGTG TGCTG GGGGG CTGGA GTGCG CCTGC CCTGC

801 CCTCC TGGAG TACGC CCGGA CCTGT GCCCA GGAGG AATG GTGCT GTACG

851 GCTGG ACCGA CCACA GCGCG TGCAG CCCAG TGTGC CCTGC TGGTA TGGAG

901 TATAG CAGT GTGTG TCCCC TTGCG CCAGG ACCTG CCAGA GCCTG CACAT

951 CAATG AAATG TGTCA GGAGC GATGC GTGGA TGGCT GCAGC TGCCC TGAGG

1001 GACAG CTCCT GGATG AAGGC CTCTG CGTGG AGAGC ACCGA GTGTC CCTGC

1051 GTGCA TTCCG GAAAG CGCTA CCCTC CCGGC ACCTC CCTCT CTCGA GACTG
```

-continued

```
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC CAGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA ACTGA AGCAT GGGGC AGGAG TTGCC ATGGA
1401 TGGCC AGGAC ATCCA GCTCC CCCTC CTGAA AGGTG ACCTC CGCAT CCAGC
1451 ATACA GTGAC GGCCT CCGTG CGCCT CAGCT ACGGG GAGGA CCTGC AGATG
1501 GACTG GGATG GCCGC GGGAG GCTGC TGGTG AAGCT GTCCC CCGTC TATGC
1551 CGGGA AGACC TGCGG CCTGT GTGGG AATTA CAATG GCAAC CAGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG GACCT GCAGA AGCAG CACAG
1701 CGATC CCTGC GCCCT CAACC CGCGC ATGAC CAGGT TCTCC GAGGA GGCGT
1751 GCGCG GTCCT GACGT CCCCC ACATT CGAGG CCTGC CATCG TGCCG TCAGC
1801 CCGCT GCCCT ACCTG CGGAA CTGCC GCTAC GACGT GTGCT CCTGC TCGGA
1851 CGGCC GCGAG TGCCT GTGCG GCGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AAGGC CAGGT GTACC TGCAG TGCGG ACCCC CTGCC AACCT
2001 GACCT GCCGC TCTCT CTCTT ACCCG GATGA GGAAT GCAAT GAGGC CTGCC
2051 TGGAG GGCTG CTTCT GCCCC CCAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA ACGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC CATCA GGGCA
2501 AGGAG TATGC CCCTG GAGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG GCCTG TGTGG AATT TTGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA ACATC
```

```
3151 ATGAA GCAGA CGATG GTGGA TTCCT CCTGT AGAAT CCTTA CCAGT GACGT
3201 CTTCC AGGAC TGCAA CAAGC TGGTG GACCC CGAGC CATAT CTGGA TGTCT
3251 GCATT TACGA CACCT GCTCC TGTGA GTCCA TTGGG GACTG CGCCG CATTC
3301 TGCGA CACCA TTGCT GCCTA TGCCC ACGTG TGTGC CCAGC ATGGC AAGGT
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC GGGTA CCTCA GAGTC TGCTA CCCCC
3751 GAGTC AGGGC CAGGA TCAGA GCCAG CCACC TCCGG GTCTG AGACA CCCGG
3801 GACTT CCGAG AGTGC CACCC CTGAG TCCGG ACCCG GTCC GAGCC CGCCA
3851 CTTCC GGCTC CGAAA CTCCC GGCAC AAGCG AGAGC GCTAC CCCAG AGTCA
3901 GGACC AGGAA CATCT ACAGA GCCCT CTGAA GGCTC CGCTC CAGGG TCCCC
3951 AGCCG GCAGT CCCAC TAGCA CCGAG GAGGG AACCT CTGAA AGCGC CACAC
4001 CCGAA TCAGG GCCAG GGTCT GAGCC TGCTA CCAGC GGCAG CGAGA CACCA
4051 GGCAC CTCTG AGTCC GCCAC ACCAG AGTCC GGACC CGGAT CTCCC GCTGG
4101 GAGCC CCACC TCCAC TGAGG AGGGA TCTCC TGCTG GCTCT CCAAC ATCTA
4151 CTGAG GAAGG TACCT CAACC GAGCC ATCCG AGGGA TCAGC TCCCG GCACC
4201 TCAGA GTCGG CAACC CCGGA GTCTG ACCCC GGAAC TTCCG AAAGT GCCAC
4251 ACCAG AGTCC GGTCC CGGGA CTTCA GAATC AGCAA CACCC GAGTC CGGCC
4301 CTGGG TCTGA ACCCG CCACA AGTGG TAGTG AGACA CCAGG ATCAG AACCT
4351 GCTAC CTCAG GGTCA GAGAC ACCCG GATCT CCGGC AGGCT CACCA ACCTC
4401 CACTG AGGAG GGCAC CAGCA CAGAA CCAAG CGAGG GCTCC GCACC CGGAA
4451 CAAGC ACTGA ACCCA GTGAG GGTTC AGCAC CCGGC TCTGA GCCGG CCACA
4501 AGTGG CAGTG AGACA CCCGG CACTT CAGAG AGTGC CACCC CGAG AGTGG
4551 CCCAG GCACT AGTAC CGAGC CCTCT GAAGG CAGTG CGCCA GATTC TGGCG
4601 GTGGA GGTTC CGGTG GCGGG GGATC CGGTG GCGGG GGATC CGGTG GCGGG
4651 GGATC CGGTG GCGGG GGATC CCTGG TCCCC CGGGG CAGCG GAGGC GACAA
4701 AACTC ACACA TGCCC ACCGT GCCCA GCTCC AGAAC TCCTG GGCGG ACCGT
4751 CAGTC TTCCT CTTCC CCCCA AAACC CAAGG ACACC CTCAT GATCT CCCGG
4801 ACCCC TGAGG TCACA TGCGT GGTGG TGGAC GTGAG CCACG AAGAC CCTGA
4851 GGTCA AGTTC AACTG GTACG TGGAC GGCGT GGAGG TGCAT AATGC CAAGA
4901 CAAAG CCGCG GGAGG AGCAG TACAA CAGCA CGTAC CGTGT GGTCA GCGTC
4951 CTCAC CGTCC TGCAC CAGGA CTGGC TGAAT GGCAA GGAGT ACAAG TGCAA
5001 GGTCT CCAAC AAAGC CCTCC CAGCC CCCAT CGAGA AAACC ATCTC CAAAG
5051 CCAAA GGGCA GCCCC GAGAA CCACA GGTGT ACACC CTGCC CCCAT CCCGG
5101 GATGA GCTGA CCAAG AACCA GGTCA GCCTG ACCTG CCTGG TCAAA GGCTT
```

-continued

```
5151 CTATC CCAGC GACAT CGCCG TGGAG TGGGA GAGCA ATGGG CAGCC GGAGA

5201 ACAAC TACAA GACCA CGCCT CCCGT GTTGG ACTCC GACGG CTCCT TCTTC

5251 CTCTA CAGCA AGCTC ACCGT GGACA AGAGC AGGTG GCAGC AGGGG AACGT

5301 CTTCT CATGC TCCGT GATGC ATGAG GCTCT GCACA ACCAC TACAC GCAGA

5351 AGAGC CTCTC CCTGT CTCCG GGTAA ATGA
```

VWF034 Protein Sequence (SEQ ID NO: 87)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL ETEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGTSESATP

1251 ESGPGSEPAT SGSETPGTSE SATPESGPGS EPATSGSETP GTSESATPES

1301 GPGTSTEPSE GSAPGSPAGS PTSTEEGTSE SATPESGPGS EPATSGSETP

1351 GTSESATPES GPGSPAGSPT STEEGSPAGS PTSTEEGTST EPSEGSAPGT

1401 SESATPESGP GTSESATPES GPGTSESATP ESGPGSEPAT SGSETPGSEP

1451 ATSGSETPGS PAGSPTSTEE GTSTEPSEGS APGTSTEPSE GSAPGSEPAT

1501 SGSETPGTSE SATPESGPGT STEPSEGSAP DIGGGGGSGG GGSLVPRGSG

1551 GDKTHTCPPC PAPELLGGPS VFLFPPKPKD TLMISRTPEV TCVVVDVSHE

1601 DPEVKFNWYV DGVEVHNAKT KPREEQYNST YRVVSVLTVL HQDWLNGKEY

1651 KCKVSNKALP APIEKTISKA KGQPREPQVY TLPPSRDELT KNQVSLTCLV
```

-continued

```
1701 KGFYPSDIAV EWESNGQPEN NYKTTPPVLD SDGSFFLYSK LTVDKSRWQQ

1751 GNVFSCSVMH EALHNHYTQK SLSLSPGK*
```

VWF050 Nucleotide Sequence (IHH Triple Mutant) (SEQ ID NO: 149)

```
   1 ATGAT TCCTG CCAGA TTTGC CGGGG TGCTG CTTGC TCTGG CCCTC ATTTT

51 GCCAG GGACC CTTTG TGCAG AAGGA ACTCG CGGCA GGTCA TCCAC GGCCC

101 GATGC AGCCT TTTCG GAAGT GACTT CGTCA CACCT TTGA TGGGA GCATG

151 TACAG CTTTG CGGGA TACTG CAGTT ACCTC CTGGC AGGGG CTGCT CAGAA

201 ACGCT CCTTC TCGAT TATTG GGGAC TTCCA GAATG CAAGT AGAGT GAGCC

251 TCTCC GTGTA TCTTG GGGAA TTTTT TGACA TCCAT TTGTT TGTCA ATGGT

301 ACCGT GACAC AGGGG GACCA AAGAG TCTCC ATGCC TATGC CTCCC AAAGG

351 GCTGT ATCTA GAAAC TGAGG CTGGG TACTA CAAGC TGTCC GGTGA GGCCT

401 ATGGC TTTGT GGCCA GGATC GATGG CAGCG GCAAC TTTCA AGTCC TGCTG

451 TCAGA CAGAT ACTTC AACAA GACCT GCGGG CTGTG TGGCA ACTTT AACAT

501 CTTTG CTGAA GATGA CTTTA TGACC CAAGA AGGGA CCTTG ACCTC GGACC

551 CTTAT GACTT TGCCA ACTCA TGGGC TCTGA GCAGT GGAGA ACAGT GGTGT

601 GAACG GCCAT CTCCT CCCAG CAGCT CATGC AACAT CTCCT CTGGG AAAAT

651 GCAGA AGGGC CTGTG GGAGC AGTGC CAGCT TCTGA GAGCC ACCTC GGTGT

701 TTGCC CGCTG CCACC CTCTG GTGGA CCCCG AGCCT TTTGT GGCCC TGTGT

751 GAGAA GACTT TGTGT GAGTG TGCTG GGGGG CTGGA GTGCG CCTGC CCTGC

801 CCTCC TGGAG TACGC CCGGA CCTGT GCCCA GGAGG GAATG GTGCT GTACG

851 GCTGG ACCGA CCACA GCGCG TGCAG CCCAG TGTGC CCTGC TGGTA TGGAG

901 TATAG CAGTG TGTG TCCCC TTGCG CCAGG ACCTG CCAGA GCCTG CACAT

951 CAATG AAATG TGTCA GGAGC GATGC GTGGA TGGCT GCAGC TGCCC TGAGG

1001 GACAG CTCCT GGATG AAGGC CTCTG CGTGG AGAGC ACCGA GTGTC CCTGC

1051 GTGCA TTCCG GAAAG CGCTA CCCTC CCGGC ACCTC CTCT CTCGA GACTG

1101 CAACA CCTGC ATTTG CCGAA ACAGC CAGTG GATCT GCAGC AATGA AGAAT

1151 GTCCA GGGGA GTGCC TTGTC ACTGG TCAAT CCCAC TTCAA GAGCT TTGAC

1201 AACAG ATACT TCACC TTCAG TGGGA TCTGC CAGTA CCTGC TGGCC CGGGA

1251 TTGCC AGGAC CACTC CTTCT CCATT GTCAT TGAGA CTGTC CAGTG TGCTG

1301 ATGAC CGCGA CGCTG TGTGC ACCCG CTCCG TCACC GTCCG GCTGC CTGGC

1351 CTGCA CAACA GCCTT GTGAA ACTGA GCATG GGGGC AGGAG TTGCC ATGGA

1401 TGGCC AGGAC ATCCA GCTCC CCCTC CTGAA GGTGA CCTCG CGCAT CCAGC

1451 ATACA GTGAC GGCCT CCGTG CGCCT CAGCT ACGGG GAGGA CCTGC AGATG

1501 GACTG GGATG GCCGC GGGAG GCTGC TGGTG AAGCT GTCCC CCGTC TATGC

1551 CGGGA AGACC TGCGG CCTGT GTGGG AATTA CAATG GCAAC CAGGG CGACG

1601 ACTTC CTTAC CCCCT CTGGG CTGGC GGAGC CCCGG GTGGA GGACT TCGGG

1651 AACGC CTGGA AGCTG CACGG GGACT GCCAG GACCT GCAGA AGCAG CACAG

1701 CGATC CCTGC GCCCT CAACC CGCGC ATGAC CAGGT TCTCC GAGGA GGCGT
```

-continued

```
1751 GCGCG GTCCT GACGT CCCCC ACATT CGAGG CCTGC CATCG TGCCG TCAGC

1801 CCGCT GCCCT ACCTG CGGAA CTGCC GCTAC GACGT GTGCT CCTGC TCGGA

1851 CGGCC GCGAG TGCCT GTGCG GCGCC CTGGC CAGCT ATGCC GCGGC TGCCG

1901 CGGGG AGAGG CGTGC GCGTC GCGTG GCGCA AGCCA GGCCG CTGTG AGCTG

1951 AACTG CCCGA AGGGC CAGGT GTACC TGCAG TGCGG ACCCC CTGC AACCT

2001 GACCT GCCGC TCTCT CTCTT ACCCG GATGA GGAAT GCAAT GAGGC CTGCC

2051 TGGAG GGCTG CTTCT GCCCC CCAGG GCTCT ACATG GATGA GAGGG GGGAC

2101 TGCGT GCCCA AGGCC CAGTG CCCCT GTTAC TATGA CGGTG AGATC TTCCA

2151 GCCAG AAGAC ATCTT CTCAG ACCAT CACAC CATGT GCTAC TGTGA GGATG

2201 GCTTC ATGCA CTGTA CCATG AGTGG AGTCC CCGGA AGCTT GCTGC CTGAC

2251 GCTGT CCTCA GCAGT CCCCT GTCTC ATCGC AGCAA AGGA GCCTA TCCTG

2301 TCGGC CCCCC ATGGT CAAGC TGGTG TGTCC CGCTG ACAAC CTGCG GGCTG

2351 AAGGG CTCGA GTGTA CCAAA ACGTG CCAGA ACTAT GACCT GGAGT GCATG

2401 AGCAT GGGCT GTGTC TCTGG CTGCC TCTGC CCCCC GGGCA TGGTC CGGCA

2451 TGAGA ACAGA TGTGT GGCCC TGGAA AGGTG TCCCT GCTTC ATCA GGGCA

2501 AGGAG TATGC CCCTG GAGAA ACAGT GAAGA TTGGC TGCAA CACTT GTGTC

2551 TGTCG GGACC GGAAG TGGAA CTGCA CAGAC CATGT GTGTG ATGCC ACGTG

2601 CTCCA CGATC GGCAT GGCCC ACTAC CTCAC CTTCG ACGGG CTCAA ATACC

2651 TGTTC CCCGG GGAGT GCCAG TACGT TCTGG TGCAG GATTA CTGCG GCAGT

2701 AACCC TGGGA CCTTT CGGAT CCTAG TGGGG AATAA GGGAT GCAGC CACCC

2751 CTCAG TGAAA TGCAA GAAAC GGGTC ACCAT CCTGG TGGAG GGAGG AGAGA

2801 TTGAG CTGTT TGACG GGGAG GTGAA TGTGA AGAGG CCCAT GAAGG ATGAG

2851 ACTCA CTTTG AGGTG GTGGA GTCTG GCCGG TACAT CATTC TGCTG CTGGG

2901 CAAAG CCCTC TCCGT GGTCT GGGAC CGCCA CCTGA GCATC TCCGT GGTCC

2951 TGAAG CAGAC ATACC AGGAG AAAGT GTGTG GCCTG TGTGG GAATT TTGAT

3001 GGCAT CCAGA ACAAT GACCT CACCA GCAGC AACCT CCAAG TGGAG GAAGA

3051 CCCTG TGGAC TTTGG AACT CCTGG AAAGT GAGCT CGCAG TGTGC TGACA

3101 CCAGA AAAGT GCCTC TGGAC TCATC CCCTG CCACC TGCCA TAACA ACATC

3151 ATGAA GCAGA CGATG GTGGA TTCCT CCTGT AGAAT CCTTA CCAGT GACGT

3201 CTTCC AGGAC TGCAA CAAGC TGGTG GACCC CGAGC CATAT CTGGA TGTCT

3251 GCATT TACGA CACCT GCTCC TGTGA GTCCA TTGGG GACTG CGCCG CATTC

3301 TGCGA CACCA TTGCT GCCTA TGCCC ACGTG TGTGC CCAGC ATGGC AAGGT

3351 GGTGA CCTGG AGGAC GGCCA CATTG TGCCC CCAGA GCTGC GAGGA GAGGA

3401 ATCTC CGGGA GAACG GGTAT GAGGC TGAGT GGCGC TATAA CAGCT GTGCA

3451 CCTGC CTGTC AAGTC ACGTG TCAGC ACCCT GAGCC ACTGG CCTGC CCTGT

3501 GCAGT GTGTG GAGGG CTGCC ATGCC CACTG CCCTC CAGGG AAAAT CCTGG

3551 ATGAG CTTTT GCAGA CCTGC GTTGA CCCTG AAGAC TGTCC AGTGT GTGAG

3601 GTGGC TGGCC GGCGT TTTGC CTCAG GAAAG AAAGT CACCT TGAAT CCCAG

3651 TGACC CTGAG CACTG CCAGA TTTGC CACTG TGATG TTGTC AACCT CACCT

3701 GTGAA GCCTG CCAGG AGCCG ATATC TGGCG GTGGA GGTTC CGGTG CGGG

3751 GGATC CGGCG GTGGA GGTTC CGGCG GTGGA GGTTC CGGTG CGGGG GGATC
```

-continued

```
3801 CGGTG GCGGG GGATC CCTGG TCCCC CGGGG CAGCG GCGGT GGAGG TTCCG
3851 GTGGC GGGGG ATCCG ACAAA ACTCA CACAT GCCCA CCGTG CCCAG CTCCA
3901 GAACT CCTGG GCGGA CCGTC AGTCT TCCTC TTCCC CCCAA AACCC AAGGA
3951 CACCC TCATG GCCTC CCGGA CCCCT GAGGT CACAT GCGTG GTGGT GGACG
4001 TGAGC CACGA AGACC CTGAG GTCAA GTTCA ACTGG TACGT GGACG GCGTG
4051 GAGGT GCATA ATGCC AAGAC AAAGC CGCGG GAGGA GCAGT ACAAC AGCAC
4101 GTACC GTGTG GTCAG CGTCC TCACC GTCCT GGCCC AGGAC TGGCT GAATG
4151 GCAAG GAGTA CAAGT GCAAG GTCTC CAACA AAGCC CTCCC AGCCC CCATC
4201 GAGAA AACCA TCTCC AAAGC CAAAG GGCAG CCCCG AGAAC CACAG GTGTA
4251 CACCC TGCCC CCATC CCGCG ATGAG CTGAC CAAGA ACCAG GTCAG CCTGA
4301 CCTGC CTGGT CAAAG GCTTC TATCC CAGCG ACATC GCCGT GGAGT GGGAG
4351 AGCAA TGGGC AGCCG GAGAA CAACT ACAAG ACCAC GCCTC CCGTG TTGGA
4401 CTCCG ACGGC TCCTT CTTCC TCTAC AGCAA GCTCA CCGTG GACAA GAGCA
4451 GGTGG CAGCA GGGGA ACGTC TTCTC ATGCT CCGTG ATGCA TGAGG CTCTG
4501 CACAA CGCCT ACACG CAGAA GAGCC TCTCC CTGTC TCCGG GTAAA TGA
```

VWF050 Protein Sequence (IHH Triple Mutant) (SEQ ID NO: 150)

```
   1 MIPARFAGVL LALALILPGT LCAEGTRGRS STARCSLFGS DFVNTFDGSM
  51 YSFAGYCSYL LAGGCQKRSF SIIGDFQNGK RVSLSVYLGE FFDIHLFVNG
 101 TVTQGDQRVS MPYASKGLYL ETEAGYYKLS GEAYGFVARI DGSGNFQVLL
 151 SDRYFNKTCG LCGNFNIFAE DDFMTQEGTL TSDPYDFANS WALSSGEQWC
 201 ERASPPSSSC NISSGEMQKG LWEQCQLLKS TSVFARCHPL VDPEPFVALC
 251 EKTLCECAGG LECACPALLE YARTCAQEGM VLYGWTDHSA CSPVCPAGME
 301 YRQCVSPCAR TCQSLHINEM CQERCVDGCS CPEGQLLDEG LCVESTECPC
 351 VHSGKRYPPG TSLSRDCNTC ICRNSQWICS NEECPGECLV TGQSHFKSFD
 401 NRYFTFSGIC QYLLARDCQD HSFSIVIETV QCADDRDAVC TRSVTVRLPG
 451 LHNSLVKLKH GAGVAMDGQD IQLPLLKGDL RIQHTVTASV RLSYGEDLQM
 501 DWDGRGRLLV KLSPVYAGKT CGLCGNYNGN QGDDFLTPSG LAEPRVEDFG
 551 NAWKLHGDCQ DLQKQHSDPC ALNPRMTRFS EEACAVLTSP TFEACHRAVS
 601 PLPYLRNCRY DVCSCSDGRE CLCGALASYA AACAGRGVRV AWREPGRCEL
 651 NCPKGQVYLQ CGTPCNLTCR SLSYPDEECN EACLEGCFCP PGLYMDERGD
 701 CVPKAQCPCY YDGEIFQPED IFSDHHTMCY CEDGFMHCTM SGVPGSLLPD
 751 AVLSSPLSHR SKRSLSCRPP MVKLVCPADN LRAEGLECTK TCQNYDLECM
 801 SMGCVSGCLC PPGMVRHENR CVALERCPCF HQGKEYAPGE TVKIGCNTCV
 851 CRDRKWNCTD HVCDATCSTI GMAHYLTFDG LKYLFPGECQ YVLVQDYCGS
 901 NPGTFRILVG NKGCSHPSVK CKKRVTILVE GGEIELFDGE VNVKRPMKDE
 951 THFEVVESGR YIILLLGKAL SVVWDRHLSI SVVLKQTYQE KVCGLCGNFD
1001 GIQNNDLTSS NLQVEEDPVD FGNSWKVSSQ CADTRKVPLD SSPATCHNNI
1051 MKQTMVDSSC RILTSDVFQD CNKLVDPEPY LDVCIYDTCS CESIGDCAAF
```

```
1101 CDTIAAYAHV CAQHGKVVTW RTATLCPQSC EERNLRENGY EAEWRYNSCA
1151 PACQVTCQHP EPLACPVQCV EGCHAHCPPG KILDELLQTC VDPEDCPVCE
1201 VAGRRFASGK KVTLNPSDPE HCQICHCDVV NLTCEACQEP ISGGGGSGGG
1251 GSGGGGSGGG GSGGGGSGGG GSLVPRGSGG GGSGGGGSDK THTCPPCPAP
1301 ELLGGPSVFL FPPKPKDTLM ASRTPEVTCV VVDVSHEDPE VKFNWYVDGV
1351 EVHNAKTKPR EEQYNSTYRV VSVLTVLAQD WLNGKEYKCK VSNKALPAPI
1401 EKTISKAKGQ PREPQVYTLP PSRDELTKNQ VSLTCLVKGF YPSDIAVEWE
1451 SNGQPENNYK TTPPVLDSDG SFFLYSKLTV DKSRWQQGNV FSCSVMHEAL
1501 HNAYTQKSLS LSPGK*
```

VWF057 Nucleotide Sequence (SEQ ID NO: 151)

```
   1 ATGAT TCCTG CCAGA TTTGC CGGGG TGCTG CTTGC TCTGG CCCTC ATTTT
  51 GCCAG GGACC CTTTG TGCAG AAGGA ACTCG CGGCA GGTCA TCCAC GGCCC
 101 GATGC AGCCT TTTCG GAAGT GACTT CGTCA CACC TTTGA TGGGA GCATG
 151 TACAG CTTTG CGGGA TACTG CAGTT ACCTC CTGGC AGGGG CTGC CAGAA
 201 ACGCT CCTTC TCGAT TATTG GGAC TTCCA GAATG CAAG AGAGT GAGCC
 251 TCTCC GTGTA TCTTG GGAA TTTTT TGACA TCCAT TTGTT TGTCA ATGGT
 301 ACCGT GACAC AGGGG GACCA AAGAG TCTCC ATGCC TATG CCTCC AAAGG
 351 GCTGT ATCTA GAAAC TGAGG CTGGG TACTA CAAGC TGTCC GGTGA GGCCT
 401 ATGGC TTTGT GGCCA GGATC GATGG CAGCG GCAAC TTTCA GTCC TGCTG
 451 TCAGA CAGAT ACTTC AACAA GACCT GCGGG CTGTG TGGCA ACTTT AACAT
 501 CTTTG CTGAA GATGA CTTTA TGACC CAAGA AGGGA CCTTG ACCTC GGACC
 551 CTTAT GACTT TGCCA ACTCA TGGGC TCTGA GCAGT GGAGA ACAGT GGTGT
 601 GAACG GGCAT CTCCT CCCAG CAGCT CATGC AACAT CTCCT CTGGG AAAT
 651 GCAGA AGGGC TGTGT GGAGC AGTGC AGCT TCTGA GAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGGG CTGGA GTGCG CCTGC CCTGC
 801 CCTCC TGGAG TACGC CCGGA CCTGT GCCCA GGAGG AATG GTGCT GTACG
 851 GCTGG ACCGA CCACA GCGCG TGCAG CCCAG TGTGC CCTGC TGGTA TGGAG
 901 TATAG CAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC CTCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA GAATA
1151 GTCCA GGGGA GTGCC TTGTC ACTGG TCAAT CCCAC TTCAA GAGCT TTGAC
1201 AACAG ATACT TCACC TTCAG TGGGA TCTGC CAGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA ACTGA AGCAT GGGGC AGGAG TTGCC ATGGA
1401 TGGCC AGGAC ATCCA GCTCC CCCTC CTGAA GGTGA CCTCG CGCAT CCAGC
1451 ATACA GTGAC GGCCT CCGTG CGCCT CAGCT ACGGG GAGGA CCTGC AGATG
```

-continued

```
1501 GACTG GGATG GCCGC GGGAG GCTGC TGGTG AAGCT GTCCC CCGTC TATGC
1551 CGGGA AGACC TGCGG CCTGT GTGGG AATTA CAATG GCAAC CAGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG GACCT GCAGA AGCAG CACAG
1701 CGATC CCTGC GCCCT CAACC CGCGC ATGAC CAGGT TCTCC GAGGA GGCGT
1751 GCGCG GTCCT GACGT CCCCC ACATT CGAGG CCTGC CATCG TGCCG TCAGC
1801 CCGCT GCCCT ACCTG CGGAA CTGCC GCTAC GACGT GTGCT CCTGC TCGGA
1851 CGGCC GCGAG TGCCT GTGCG GCGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AAGGC CAGGT GTACC TGCAG TGCGG ACCCC CTGC AACCT
2001 GACCT GCCGC TCTCT CTCTT ACCCG GATGA GGAAT GCAAT GAGGC CTGCC
2051 TGGAG GGCTG CTTCT GCCCC CCAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AAGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA ACGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC CATCA GGGCA
2501 AGGAG TATGC CCCTG GAGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG GCCTG TGTGG GAATT TTGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA ACATC
3151 ATGAA GCAGA CGATG GTGGA TTCCT CCTGT AGAAT CCTTA CCAGT GACGT
3201 CTTCC AGGAC TGCAA CAAGC TGGTG GACCC CGAGC CATAT CTGGA TGTCT
3251 GCATT TACGA CACCT GCTCC TGTGA GTCCA TTGGG GACTG CGCCG CATTC
3301 TGCGA CACCA TTGCT GCCTA TGCCC ACGTG TGTGC CCAGC ATGGC AAGGT
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
```

-continued

```
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG AAAGA AAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC GGGCG CGCCA ACATC AGAGA GCGCC
3751 ACCCC TGAAA GTGGT CCCGG GAGCG AGCCA GCCAC ATCTG GGTCG AAAC
3801 GCCAG GCACA AGTGA GTCTG CAACT CCCGA GTCCG GACCT GGCTC CGAGC
3851 CTGCC ACTAG CGGCT CCGAG ACTCC GGGAA CTTCC GAGAG CGCTA CACCA
3901 GAAAG CGGAC CCGGA ACCAG TACCG AACCT AGCGA GGGCT CTGCT CCGGG
3951 CAGCC CAGCC GGCTC TCCTA CATCC ACGGA GGAGG GCACT TCCGA ATCCG
4001 CCACC CCGGA GTCAG GGCCA GGATC TGAAC CCGCT ACCTC AGGCA GTGAG
4051 ACGCC AGGAA CGAGC GAGTC CGCTA CACCG GAGAG TGGGC CAGGG AGCCC
4101 TGCTG GATCT CCTAC GTCCA CTGAG GAAGG GTCAC CAGCG GGCTC GCCCA
4151 CCAGC ACTGA AGAAG GTGCC TCGAG CGGCG GTGGA GGTTC CGGTG GCGGG
4201 GGATC CGGTG GCGGG GGATC CGGTG GCGGG GGATC CGGTG GCGGG GGATC
4251 CCTGG TCCCC CGGGG CAGCG GAGGC GACAA AACTC ACACA TGCCC ACCGT
4301 GCCCA GCTCC AGAAC TCCTG GGCGG ACCGT CAGTC TTCCT CTTCC CCCCA
4351 AAACC CAAGG ACACC CTCAT GATCT CCCGG ACCCC TGAGG TCACA TGCGT
4401 GGTGG TGGAC GTGAG CCACG AAGAC CCTGA GGTCA AGTTC AACTG GTACG
4451 TGGAC GGCGT GGAGG TGCAT AATGC CAAGA CAAAG CCGCG GGAGG AGCAG
4501 TACAA CAGCA CGTAC CGTGT GGTCA GCGTC CTCAC CGTCC TGCAC CAGGA
4551 CTGGC TGAAT GGCAA GGAGT ACAAG TGCAA GGTCT CCAAC AAAGC CCTCC
4601 CAGCC CCCAT CGAGA AAACC ATCTC CAAAG CCAAA GGGCA GCCCC GAGAA
4651 CCACA GGTGT ACACC CTGCC CCCAT CCCGG GATGA GCTGA CCAAG AACCA
4701 GGTCA GCCTG ACCTG CCTGG TCAAA GGCTT CTATC CCAGC GACAT CGCCG
4751 TGGAG TGGGA GAGCA ATGGG CAGCC GGAGA ACAAC TACAA GACCA CGCCT
4801 CCCGT GTTGG ACTCC GACGG CTCCT TCTTC CTCTA CAGCA AGCTC ACCGT
4851 GGACA AGAGC AGGTG GCAGC AGGGG AACGT CTTCT CATGC TCCGT GATGC
4901 ATGAG GCTCT GCACA ACCAC TACAC GCAGA AGAGC CTCTC CCTGT CTCCG
4951 GGTAA ATGA
```

VWF057 Protein Sequence (SEQ ID NO: 152)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL ETEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
```

-continued

```
 451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGAPTSESA

1251 TPESGPGSEP ATSGSETPGT SESATPESGP GSEPATSGSE TPGTSESATP

1301 ESGPGTSTEP SEGSAPGSPA GSPTSTEEGT SESATPESGP GSEPATSGSE

1351 TPGTSESATP ESGPGSPAGS PTSTEEGSPA GSPTSTEEGA SSGGGGSGGG

1401 GSGGGGSGGG GSGGGGSLVP RGSGGDKTHT CPPCPAPELL GGPSVFLFPP

1451 KPKDTLMISR TPEVTCVVVD VSHEDPEVKF NWYVDGVEVH NAKTKPREEQ

1501 YNSTYRVVSV LTVLHQDWLN GKEYKCKVSN KALPAPIEKT ISKAKGQPRE

1551 PQVYTLPPSR DELTKNQVSL TCLVKGFYPS DIAVEWESNG QPENNYKTTP

1601 PVLDSDGSFF LYSKLTVDKS RWQQGNVFSC SVMHEALHNH YTQKSLSLSP

1651 GK*
```

VWF058 Nucleotide Sequence (VWF034 with IHH Mutation) (SEQ ID NO: 153)

```
   1 ATGAT TCCTG CCAGA TTTGC CGGGG TGCTG CTTGC TCTGG CCCTC ATTTT

51 GCCAG GGACC CTTTG TGCAG AAGGA ACTCG CGGCA GGTCA TCCAC GGCCC

101 GATGC AGCCT TTTCG AAGTG ACTTC GTCAC ACACC TTTGA TGGGA GCATG

151 TACAG CTTTG CGGGA TACTG CAGTT ACCTC CTGGC AGGGG CTGCC AGAA

201 ACGCT CCTTC TCGAT TATTG GGAC TTCCA GAATG CAAGA GAGT GAGCC

251 TCTCC GTGTA TCTTG GGGAA TTTTT TGACA TCCAT TGTT TGTCA ATGGT

301 ACCGT GACAC AGGGG GACCA AAGAG TCTCC ATGCC CTATG CCTCC AAAGG

351 GCTGT ATCTA GAAAC TGAGG CTGGG TACTA CAAGC TGTCC GGTGA GGCCT

401 ATGGC TTTGT GGCCA GGATC GATGG CAGCG GCAAC TTTCA GTCC TGCTG

451 TCAGA CAGAT ACTTC AACAA GACCT GCGGG CTGTG TGGCA ACTTT AACAT

501 CTTTG CTGAA GATGA CTTTA TGACC CAAGA AGGGA CCTTG ACCTC GGACC

551 CTTAT GACTT TGCCA ACTCA TGGGC TCTGA GCAGT GGAGA ACAGT GGTGT
```

```
 601 GAACG GGCAT CTCCT CCCAG CAGCT CATGC AACAT CTCCT CTGGG GAAAT
 651 GCAGA AGGGC CTGTG GGAGC AGTGC CAGCT TCTGA AGAGC ACCTC GGTGT
 701 TTGCC CGCTG CCACC CTCTG GTGGA CCCCG AGCCT TTTGT GGCCC TGTGT
 751 GAGAA GACTT TGTGT GAGTG TGCTG GGGGG CTGGA GTGCG CCTGC CCTGC
 801 CCTCC TGGAG TACGC CCGGA CCTGT GCCCA GGAGG GAATG GTGCT GTACG
 851 GCTGG ACCGA CCACA GCGCG TGCAG CCCAG TGTGC CCTGC TGGTA TGGAG
 901 TATAG GCAGT GTGTG TCCCC TTGCG CCAGG ACCTG CCAGA GCCTG CACAT
 951 CAATG AAATG TGTCA GGAGC GATGC GTGGA TGGCT GCAGC TGCCC TGAGG
1001 GACAG CTCCT GGATG AAGGC CTCTG CGTGG AGAGC ACCGA GTGTC CCTGC
1051 GTGCA TTCCG GAAAG CGCTA CCCTC CCGGC ACCTC CCTCT CTCGA GACTG
1101 CAACA CCTGC ATTTG CCGAA ACAGC CAGTG GATCT GCAGC AATGA AGAAT
1151 GTCCA GGGGA GTGCC TTGTC ACTGG TCAAT CCCAC TTCAA GAGCT TTGAC
1201 AACAG ATACT TCACC TTCAG TGGGA TCTGC AGTA CCTGC TGGCC CGGGA
1251 TTGCC AGGAC CACTC CTTCT CCATT GTCAT TGAGA CTGTC CAGTG TGCTG
1301 ATGAC CGCGA CGCTG TGTGC ACCCG CTCCG TCACC GTCCG GCTGC CTGGC
1351 CTGCA CAACA GCCTT GTGAA ACTGA AGCAT GGGGC AGGAG TTGCC ATGGA
1401 TGGCC AGGAC ATCCA GCTCC CCCTC CTGAA GGTG ACCTC CGCAT CCAGC
1451 ATACA GTGAC GGCCT CCGTG CGCCT CAGCT ACGGG GAGGA CCTGC AGATG
1501 GACTG GGATG GCCGC GGGAG GCTGC TGGTG AAGCT GTCCC CCGTC TATGC
1551 CGGGA AGACC TGCGG CCTGT GTGGG AATTA CAATG GCAAC CAGGG CGACG
1601 ACTTC CTTAC CCCCT CTGGG CTGGC GGAGC CCCGG GTGGA GGACT TCGGG
1651 AACGC CTGGA AGCTG CACGG GGACT GCCAG GACCT GCAGA AGCAG CACAG
1701 CGATC CCTGC GCCCT CAACC CGCGC ATGAC CAGGT TCTCC GAGGA GGCGT
1751 GCGCG GTCCT GACGT CCCCC ACATT CGAGG CCTGC CATCG TGCCG TCAGC
1801 CCGCT GCCCT ACCTG CGGAA CTGCC GCTAC GACGT GTGCT CCTGC TCGGA
1851 CGGCC GCGAG TGCCT GTGCG GCGCC CTGGC CAGCT ATGCC GCGGC CTGCG
1901 CGGGG AGAGG CGTGC GCGTC GCGTG GCGCG AGCCA GGCCG CTGTG AGCTG
1951 AACTG CCCGA AGGGC CAGGT GTACC TGCAG TGCGG ACCCC CTGCA AACCT
2001 GACCT GCCGC TCTCT CTCTT ACCCG GATGA GGAAT GCAAT GAGGC CTGCC
2051 TGGAG GGCTG CTTCT GCCCC CCAGG GCTCT ACATG GATGA GAGGG GGGAC
2101 TGCGT GCCCA AGGCC CAGTG CCCCT GTTAC TATGA CGGTG AGATC TTCCA
2151 GCCAG AAGAC ATCTT CTCAG ACCAT CACAC CATGT GCTAC TGTGA GGATG
2201 GCTTC ATGCA CTGTA CCATG AGTGG AGTCC CCGGA AGCTT GCTGC CTGAC
2251 GCTGT CCTCA GCAGT CCCCT GTCTC ATCGC AGCAA AGGA GCCTA TCCTG
2301 TCGGC CCCCC ATGGT CAAGC TGGTG TGTCC CGCTG ACAAC CTGCG GGCTG
2351 AAGGG CTCGA GTGTA CCAAA ACGTG CCAGA ACTAT GACCT GGAGT GCATG
2401 AGCAT GGGCT GTGTC TCTGG CTGCC TCTGC CCCCC GGGCA TGGTC CGGCA
2451 TGAGA ACAGA TGTGT GGCCC TGGAA AGGTG TCCCT GCTTC ATCA GGGCA
2501 AGGAG TATGC CCCTG GAGAA ACAGT GAAGA TTGGC TGCAA CACTT GTGTC
2551 TGTCG GGACC GGAAG TGGAA CTGCA CAGAC CATGT GTGTG ATGCC ACGTG
2601 CTCCA CGATC GGCAT GGCCC ACTAC CTCAC CTTCG ACGGG CTCAA ATACC
```

-continued

```
2651 TGTTC CCCGG GGAGT GCCAG TACGT TCTGG TGCAG GATTA CTGCG GCAGT
2701 AACCC TGGGA CCTTT CGGAT CCTAG TGGGG AATAA GGGAT GCAGC CACCC
2751 CTCAG TGAAA TGCAA GAAAC GGGTC ACCAT CCTGG TGGAG GGAGG AGAGA
2801 TTGAG CTGTT TGACG GGGAG GTGAA TGTGA AGAGG CCCAT GAAGG ATGAG
2851 ACTCA CTTTG AGGTG GTGGA GTCTG GCCGG TACAT CATTC TGCTG CTGGG
2901 CAAAG CCCTC TCCGT GGTCT GGGAC CGCCA CCTGA GCATC TCCGT GGTCC
2951 TGAAG CAGAC ATACC AGGAG AAAGT GTGTG CCCTG TGTGG GAATT TTGAT
3001 GGCAT CCAGA ACAAT GACCT CACCA GCAGC AACCT CCAAG TGGAG GAAGA
3051 CCCTG TGGAC TTTGG GAACT CCTGG AAAGT GAGCT CGCAG TGTGC TGACA
3101 CCAGA AAAGT GCCTC TGGAC TCATC CCCTG CCACC TGCCA TAACA ACATC
3151 ATGAA GCAGA CGATG GTGGA TTCCT CCTGT AGAAT CCTTA CCAGT GACGT
3201 CTTCC AGGAC TGCAA CAAGC TGGTG ACCCC CGAGC CATAT CTGGA TGTCT
3251 GCATT TACGA CACCT GCTCC TGTGA GTCCA TTGGG ACTG CGCCG CATTC
3301 TGCGA CACCA TTGCT GCCTA TGCCC ACGTG TGTGC CCAGC ATGGC AAGGT
3351 GGTGA CCTGG AGGAC GGCCA CATTG TGCCC CCAGA GCTGC GAGGA GAGGA
3401 ATCTC CGGGA GAACG GGTAT GAGGC TGAGT GGCGC TATAA CAGCT GTGCA
3451 CCTGC CTGTC AAGTC ACGTG TCAGC ACCCT GAGCC ACTGG CCTGC CCTGT
3501 GCAGT GTGTG GAGGG CTGCC ATGCC CACTG CCCTC CAGGG AAAAT CCTGG
3551 ATGAG CTTTT GCAGA CCTGC GTTGA CCCTG AAGAC TGTCC AGTGT GTGAG
3601 GTGGC TGGCC GGCGT TTTGC CTCAG GAAAG AAAGT CACCT TGAAT CCCAG
3651 TGACC CTGAG CACTG CCAGA TTTGC CACTG TGATG TTGTC AACCT CACCT
3701 GTGAA GCCTG CCAGG AGCCG ATATC GGGTA CCTCA GAGTC TGCTA CCCCC
3751 GAGTC AGGGC CAGGA TCAGA GCCAG CCACC TCCGG GTCTG AGACA CCCGG
3801 GACTT CCGAG AGTGC CACCC CTGAG TCCGG ACCCG GTCCA GAGCC CGCCA
3851 CTTCC GGCTC CGAAA CTCCC GGCAC AAGCG AGAGC GCTAC CCCAG AGTCA
3901 GGACC AGGAA CATCT ACAGA GCCCT CTGAA GGCTC CGCTC CAGGG TCCCC
3951 AGCCG GCAGT CCCAC TAGCA CCGAG GAGGG AACCT CTGAA AGCGC CACAC
4001 CCGAA TCAGG GCCAG GGTCT GAGCC TGCTA CCAGC GGCAG CGAGA CACCA
4051 GGCAC CTCTG AGTCC GCCAC ACCAG AGTCC GGACC CGGAT CTCCC GCTGG
4101 GAGCC CCACC TCCAC TGAGG AGGGA TCTCC TGCTG GCTCT CCAAC ATCTA
4151 CTGAG GAAGG TACCT CAACC GAGCC ATCCA GGGA TCAGC TCCCG GCACC
4201 TCAGA GTCGG CAACC CCGGA GTCTG GACCC GGAAC TTCCG AAAGT GCCAC
4251 ACCAG AGTCC GGTCC CGGGA CTTCA GAATC AGCAA CACCC GAGTC CGGCC
4301 CTGGG TCTGA ACCCG CCACA AGTGG TAGTG AGACA CCAGG ATCAG AACCT
4351 GCTAC CTCAG GGTCA GAGAC ACCCG GATCT CCGGC AGGCT CACCA ACCTC
4401 CACTG AGGAG GGCAC CAGCA CAGAA CCAAG CGAGG GCTCC GCACC CGGAA
4451 CAAGC ACTGA ACCCA GTGAG GGTTC AGCAC CCGGC TCTGA GCCGG CCACA
4501 AGTGG CAGTG AGACA CCCGG CACTT CAGAG AGTGC CACCC CCGAG AGTGG
4551 CCCAG GCACT AGTAC CGAGC CCTCT GAAGG CAGTG CGCCA GATTC TGGCG
4601 GTGGA GGTTC CGGTG GCGGG GGATC CGGTG GCGGG GGATC CGGTG GCGGG
```

-continued

```
4651 GGATC CGGTG GCGGG GGATC CCTGG TCCCC CGGGG CAGCG GAGGC GACAA

4701 AACTC ACACA TGCCC ACCGT GCCCA GCTCC AGAAC TCCTG GGCGG ACCGT

4751 CAGTC TTCCT CTTCC CCCCA AAACC CAAGG ACACC CTCAT GGCCT CCCGG

4801 ACCCC TGAGG TCACA TGCGT GGTGG TGGAC GTGAG CCACG AAGAC CCTGA

4851 GGTCA AGTTC AACTG GTACG TGGAC GGCGT GGAGG TGCAT AATGC AAGA

4901 CAAAG CCGCG GGAGG AGCAG TACAA CAGCA CGTAC CGTGT GGTCA GCGTC

4951 CTCAC CGTCC TGGCC CAGGA CTGGC TGAAT GGCAA GGAGT ACAAG TGCAA

5001 GGTCT CCAAC AAAGC CCTCC CAGCC CCCAT CGAGA AAACC ATCTC CAAAG

5051 CCAAA GGGCA GCCCC GAGAA CCACA GGTGT ACACC CTGCC CCCAT CCCGC

5101 GATGA GCTGA CCAAG AACCA GGTCA GCCTG ACCTG CCTGG TCAAA GGCTT

5151 CTATC CCAGC GACAT CGCCG TGGAG TGGGA GAGCA ATGGG CAGCC GGAGA

5201 ACAAC TACAA GACCA CGCCT CCCGT GTTGG ACTCC GACGG CTCCT TCTTC

5251 CTCTA CAGCA AGCTC ACCGT GGACA AGAGC AGGTG GCAGC AGGGG AACGT

5301 CTTCT CATGC TCCGT GATGC ATGAG GCTCT GCACA ACCAC TACAC GCAGA

5351 AGAGC CTCTC CCTGT CTCCG GGTAA ATGA
```

VWF058 Protein Sequence (VWF034 with IHH Mutation)
(SEQ ID NO: 154)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL ETEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA
```

```
1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGTSESATP

1251 ESGPGSEPAT SGSETPGTSE SATPESGPGS EPATSGSETP GTSESATPES

1301 GPGTSTEPSE GSAPGSPAGS PTSTEEGTSE SATPESGPGS EPATSGSETP

1351 GTSESATPES GPGSPAGSPT STEEGSPAGS PTSTEEGTST EPSEGSAPGT

1401 SESATPESGP GTSESATPES GPGTSESATP ESGPGSEPAT SGSETPGSEP

1451 ATSGSETPGS PAGSPTSTEE GTSTEPSEGS APGTSTEPSE GSAPGSEPAT

1501 SGSETPGTSE SATPESGPGT STEPSEGSAP DSGGGGSGGG GSGGGGSGGG

1551 GSGGGGSLVP RGSGGDKTHT CPPCPAPELL GGPSVFLFPP KPKDTLMASR

1601 TPEVTCVVVD VSHEDPEVKF NWYVDGVEVH NAKTKPREEQ YNSTYRVVSV

1651 LTVLAQDWLN GKEYKCKVSN KALPAPIEKT ISKAKGQPRE PQVYTLPPSR

1701 DELTKNQVSL TCLVKGFYPS DIAVEWESNG QPENNYKTTP PVLDSDGSFF

1751 LYSKLTVDKS RWQQGNVFSC SVMHEALHNA YTQKSLSLSP GK*
```

FVIII 169 Nucleotide Sequence (SEQ ID NO: 155)

```
   1 ATGCA AATAG AGCTC TCCAC CTGCT TCTTT CTGTG CCTTT TGCGA TTCTG

51 CTTTA GTGCC ACCAG AAGAT ACTAC CTGGG TGCAG TGGAA CTGTC ATGGG

101 ACTAT ATGCA AAGTG ATCTC GGTGA GCTGC CTGTG GACGC AAGAT TTCCT

151 CCTAG AGTGC AAAA TCTTT TCCAT TCAAC CCTCA GTCGT GTAC AAAAA

201 GACTC TGTTT GTAGA ATTCA CGGAT CACCT TTTCA ACATC GCTAA GCCAA

251 GGCCA CCCTG GATGG GTCTG CTAGG TCCTA CCATC CAGGC TGAGG TTTAT

301 GATAC AGTGG TCATT ACACT TAAGA ACATG GCTTC CCATC CTGTC AGTCT

351 TCATG CTGTT GGTGT ATCCT ACTGG AAAGC TTCTG AGGGA GCTGA ATATG

401 ATGAT CAGAC CAGTC AAAGG GAGAA AGAAG ATGAT AAAGT CTTCC CTGGT

451 GGAAG CCATA CATAT GTCTG GCAGG TCCTG AAAGA GAATG GTCCA ATGGC

501 CTCTG ACCCA CTGTG CCTTA CCTAC TCATA TCTTT CTCAT GTGGA CCTGG

551 TAAAA GACTT GAATT CAGGC TCAT GGAGC CCTA CTAGT ATGTA GAGAA

601 GGGAG TCTGG CCAAG GAAAA GACAC AGACC TTGCA CAAAT TTATA CTACT

651 TTTTG CTGTA TTTGA TGAAG GGAAA AGTTG GCACT CAGAA ACAAA GAACT

701 CCTTG ATGCA GGATA GGGAT GCTGC ATCTG CTCGG GCCTG GCCTA AAATG

751 CACAC AGTCA ATGGT TATGT AAACA GGTCT CTGCC AGGTC TGATT GGATG

801 CCACA GGAAA TCAGT CTATT GGCAT GTGAT TGGAA TGGGC ACCAC TCCTG

851 AAGTG CACTC AATAT CCTC GAAGG TCACA CATTT CTTGT GAGGA ACCAT

901 CGCCA GGCTA GCTTG GAAAT CTCGC CAATA ACTTT CCTTA CTGCT CAAAC

951 ACTCT TGATG GACCT GGGAC AGTTT CTACT GTTTT GTCAT ATCTC TTCCC

1001 ACCAA CATGA TGGCA TGGAA GCTTA TGTCA AAGTA GACAG CTGTC CAGAG

1051 GAACC CCAAC TACGA ATGAA AAATA ATGAA GAAGC GGAAG ACTAT GATGA

1101 TGATC TTACT GATTC TGAAA TGGAT GTGGT CAGGT TTGAT GATGA CAACT

1151 CTCCT TCCTT TATCC AAATT CGCTC AGTTG CCAAG AAGCA TCCTA AAACT

1201 TGGGT ACATT ACATT GCTGC TGAAG AGGAG GACTG GGACT ATGCT CCCTT
```

```
-continued
1251 AGTCC TCGCC CCCGA TGACA GAAGT TATAA AAGTC AATAT TTGAA CAATG

1301 GCCCT CAGCG GATTG GTAGG AAGTA CAAAA AAGTC CGATT TATGG CATAC

1351 ACAGA TGAAA CCTTT AAGAC TCGTG AAGCT ATTCA GCATG AATCA GGAAT

1401 CTTGG GACCT TTACT TTATG GGGAA GTTGG AGACA CACTG TTGAT TATAT

1451 TTAAG AATCA AGCAA GCAGA CCATA TAACA TCTAC CCTCA CGGAA TCACT

1501 GATGT CCGTC CTTTG TATTC AAGGA GATTA CCAAA AGGTG TAAAA CATTT

1551 GAAGG ATTTT CCAAT TCTGC CAGGA GAAAT ATTCA AATAT AAATG GACAG

1601 TGACT GTAGA AGATG GGCCA ACTAA ATCAG ATCCT CGGTG CCTGA CCCGC

1651 TATTA CTCTA GTTTC GTTAA TATGG AGAGA GATCT AGCTT CAGGA CTCAT

1701 TGGCC CTCTC CTCAT CTGCT ACAAA GAATC TGTAG ATCAA GAGG AAACC

1751 AGATA ATGTC AGACA AGAGG AATGT CATCC TGTTT TCTGT ATTTG ATGAG

1801 AACCG AAGCT GGTAC CTCAC AGAGA ATATA CAACG CTTTC TCCCC AATCC

1851 AGCTG GAGTG CAGCT TGAGG ATCCA GAGTT CCAAG CCTCC AACAT CATGC

1901 ACAGC ATCAA TGGCT ATGTT TTTGA TAGTT TGCAG TTGTC AGTTT GTTTG

1951 CATGA GGTGG CATAC TGGTA CATTC TAAGC ATTGG AGCAC AGACT GACTT

2001 CCTTT CTGTC TTCTT CTCTG GATAT ACCTT CAAAC ACAAA ATGGT CTATG

2051 AAGAC ACACT CACCC TATTC CCATT CTCAG GAGAA ACTGT CTTCA TGTCG

2101 ATGGA AAACC CAGGT CTATG GATTC TGGGG TGCCA CAACT CAGAC TTTCG

2151 GAACA GAGGC ATGAC CGCCT TACTG AAGGT TTCTA GTTGT GACAA GAACA

2201 CTGGT GATTA TTACG AGGAC AGTTA TGAAG ATATT TCAGC ATACT TGCTG

2251 AGTAA AAACA ATGCC ATTGA ACCAA GAAGC TTCTC TCAAA ACGGC GCGCC

2301 AGGTA CCTCA GAGTC TGCTA CCCCC GAGTC AGGGC CAGGA TCAGA GCCAG

2351 CCACC TCCGG GTCTG AGACA CCCGG GACTT CCGAG AGTGC CACCC CTGAG

2401 TCCGG ACCCG GGTCC GAGCC CGCCA CTTCC GGCTC CGAAA CTCCC GGCAC

2451 AAGCG AGAGC GCTAC CCCAG AGTCA GGACC AGGAA CATCT ACAGA GCCCT

2501 CTGAA GGCTC CGCTC CAGGG TCCCC AGCCG GCAGT CCCAC TAGCA CCGAG

2551 GAGGG AACCT CTGAA AGCGC CACAC CCGAA TCAGG CCCAG GGTCT GAGCC

2601 TGCTA CCAGC GGCAG CGAGA CACCA GGCAC CTCTG AGTCC GCCAC ACCAG

2651 AGTCC GGACC CGGAT CTCCC GCTGG AGCCC CACC TCCAC TGAGG AGGGA

2701 TCTCC TGCTG GCTCT CCAAC ATCTA CTGAG GAAGG TACCT CAACC GAGCC

2751 ATCCG AGGGA TCAGC TCCCG GCACC TCAGA GTCGG CAACC CCGGA GTCTG

2801 GACCC GGAAC TTCCG AAAGT GCCAC ACCAG AGTCC GGTCC CGGGA CTTCA

2851 GAATC AGCAA CACCC GAGTC CGGCC CTGGG TCTGA ACCCG CCACA AGTGG

2901 TAGTG AGACA CCAGG ATCAG AACCT GCTAC CTCAG GGTCA GAGAC ACCCG

2951 GATCT CCGGC AGGCT CACCA ACCTC CACTG AGGAG GCAC AGCA CAGAA

3001 CCAAG CGAGG GCTCC GCACC CGGAA CAAGC ACTGA ACCCA GTGAG GGTTC

3051 AGCAC CCGGC TCTGA GCCGG CCACA AGTGG CAGTG AGACA CCCGG CACTT

3101 CAGAG AGTGC CACCC CCGAG AGTGG CCCAG GCACT AGTAC CGAGC CCTCT

3151 GAAGG CAGTG CGCCA GCCTC GAGCC CACCA GTCTT GAAAC GCCAT CAAGC

3201 TGAAA TAACT CGTAC TACTC TTCAG TCAGA TCAAG AGGAA ATCGA TTATG

3251 ATGAT ACCAT ATCAG TTGAA ATGAA GAAGG AAGAT TTTGA CATTT ATGAT
```

-continued

```
3301 GAGGA TGAAA ATCAG AGCCC CCGCA GCTTT CAAAA GAAAA CACGA CACTA
3351 TTTTA TTGCT GCAGT GGAGA GGCTC TGGGA TTATG GGATG AGTAG CTCCC
3401 CACAT GTTCT AAGAA ACAGG GCTCA GAGTG GCAGT GTCCC TCAGT TCAAG
3451 AAAGT TGTTT CCAG GAATT TACTG ATGGC TCCTT TACTC AGCCC TTATA
3501 CCGTG GAGAA CTAAA TGAAC ATTTG GGACT CCTGG GGCCA TATAT AAGAG
3551 CAGAA GTTGA AGATA ATATC ATGGT AACTT TCAGA AATCA GGCCT CTCGT
3601 CCCTA TTCCT TCTAT TCTAG CCTTA TTTCT TATGA GGAAG ATCAG AGGCA
3651 AGGAG CAGAA CCTAG AAAAA ACTTT GTCAA GCCTA ATGAA ACCAA AACTT
3701 ACTTT TGGAA AGTGC AACAT CATAT GGCAC CCACT AAAGA TGAGT TTGAC
3751 TGCAA AGCCT GGGCT TATTT CTCTG ATGTT GACCT GGAAA AAGAT GTGCA
3801 CTCAG GCCTG ATTGG ACCCC TTCTG GTCTG CCACA CTAAC ACACT GAACC
3851 CTGCT CATGG GAGAC AAGTG ACAGT ACAGG AATTT GCTCT GTTTT TCACC
3901 ATCTT TGATG AGACC AAAAG CTGGT ACTTC ACTGA AAATA TGGAA AGAAA
3951 CTGCA GGGCT CCCTG CAATA TCCAG ATGGA AGATC CCACT TTTAA AGAGA
4001 ATTAT CGCTT CCATG CAATC AATGG CTACA TAATG GATAC ACTAC CTGGC
4051 TTAGT AATGG CTCAG GATCA AAGGA TTCGA TGGTA TCTGC TCAGC ATGGG
4101 CAGCA ATGAA AACAT CCATT CTATT CATTT CAGTG GACAT GTGTT CACTG
4151 TACGA AAAAA AGAGG AGTAT AAAAT GGCAC TGTAC AATCT CTATC CAGGT
4201 GTTTT TGAGA CAGTG GAAAT GTTAC CATCC AAAGC TGGAA TTTGG CGGGT
4251 GGAAT GCCTT ATTGG CGAGC ATCTA CATGC TGGGA TGAGC ACACT TTTTC
4301 TGGTG TACAG CAATA AGTGT CAGAC TCCCC TGGGA ATGGC TTCTG GACAC
4351 ATTAG AGATT TTCAG ATTAC AGCTT CAGGA CAATA TGGAC AGTGG GCCCC
4401 AAAGC TGGCC AGACT TCATT ATTCC GGATC AATCA ATGCC TGGAG CACCA
4451 AGGAG CCCTT TTCTT GGATC AAGGT GGATC TGTTG GCACC AATGA TTATT
4501 CACGG CATCA AGACC CAGGG TGCCC GTCAG AAGTT CTCCA GCCTC TACAT
4551 CTCTC AGTTT ATCAT CATGT ATAGT CTTGA TGGGA AGAAG TGGCA GACTT
4601 ATCGA GGAAA TTCCA CTGGA ACCTT AATGG TCTTC TTTGG CAATG TGGAT
4651 TCATC TGGGA TAAAA CACAA TATTT TTAAC CCTCC AATTA TTGCT CGATA
4701 CATCC GTTTG CACCC AACTC ATTAT AGCAT TCGCA GCACT CTTCG CATGG
4751 AGTTG ATGGG CTGTG ATTTA AATAG TTGCA GCATG CCATT GGGAA TGGAG
4801 AGTAA AGCAA TATCA GATGC ACAGA TTACT GCTTC ATCCT ACTTT ACCAA
4851 TATGT TTGCC ACCTG GTCTC CTTCA AAAGC TCGAC TTCAC CTCCA AGGGA
4901 GGAGT AATGC TGGA GACCT CAGGT GAATA ATCCA AAAGA GTGGC TGCAA
4951 GTGGA CTTCC AGAAG ACAAT GAAAG TCACA GGAGT AACTA CTCAG GGAGT
5001 AAAAT CTCTG CTTAC AGCA TGTAT GTGAA GGAGT TCCTC ATCTC CAGCA
5051 GTCAA GATGG CCATC AGTGG ACTCT CTTTT TTCAG AATGG CAAAG TAAAG
5101 GTTTT TCAGG GAAAT CAAGA CTCCT TCACA CCTGT GGTGA ACTCT CTAGA
5151 CCCAC CGTTA CTGAC TCGCT ACCTT CGAAT TCACC CCCAG AGTTG GGTGC
5201 ACCAG ATTGC CCTGA GGATG GAGGT TCTGG CTGC GAGGC ACAGG ACCTC
5251 TACGA CAAAA CTCAC ACATG CCCAC CGTGC CCAGC TCCAG AACTC CTGGG
```

```
5301 CGGAC CGTCA GTCTT CCTCT TCCCC CCAAA ACCCA AGGAC ACCCT CATGA

5351 TCTCC CGGAC CCCTG AGGTC ACATG CGTGG TGGTG GACGT GAGCC ACGAA

5401 GACCC TGAGG TCAAG TTCAA CTGGT ACGTG GACGG CGTGG AGGTG CATAA

5451 TGCCA AGACA AAGCC GCGGG AGGAG CAGTA CAACA GCACG TACCG TGTGG

5501 TCAGC GTCCT CACCG TCCTG CACCA GGACT GGCTG AATGG CAAGG AGTAC

5551 AAGTG CAAGG TCTCC AACAA AGCCC TCCCA GCCCC CATCG AGAAA ACCAT

5601 CTCCA AAGCC AAAGG GCAGC CCCGA GAACC ACAGG TGTAC ACCCT GCCCC

5651 CATCC CGGGA TGAGC TGACC AAGAA CCAGG TCAGC CTGAC CTGCC TGGTC

5701 AAAGG CTTCT ATCCC AGCGA CATCG CCGTG GAGTG GGAGA GCAAT GGGCA

5751 GCCGG AGAAC AACTA CAAGA CCACG CCTCC CGTGT TGGAC TCCGA CGGCT

5801 CCTTC TTCCT CTACA GCAAG CTCAC CGTGG ACAAG AGCAG GTGGC AGCAG

5851 GGGAA CGTCT TCTCA TGCTC CGTGA TGCAT GAGGC TCTGC ACAAC CACTA

5901 CACGC AGAAG AGCCT CTCCC TGTCT CCGGG TAAAT GA
```

FVIII 169 Protein Sequence (SEQ ID NO: 70)

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNGAPGTS ESATPESGPG SEPATSGSET PGTSESATPE

801 SGPGSEPATS GSETPGTSES ATPESGPGTS TEPSEGSAPG SPAGSPTSTE

851 EGTSESATPE SGPGSEPATS GSETPGTSES ATPESGPGSP AGSPTSTEEG

901 SPAGSPTSTE EGTSTEPSEG SAPGTSESAT PESGPGTSES ATPESGPGTS

951 ESATPESGPG SEPATSGSET PGSEPATSGS ETPGSPAGSP TSTEEGTSTE

1001 PSEGSAPGTS TEPSEGSAPG SEPATSGSET PGTSESATPE SGPGTSTEPS

1051 EGSAPASSPP VLKRHQAEIT RTTLQSDQEE IDYDDTISVE MKKEDFDIYD

1101 EDENQSPRSF QKKTRHYFIA AVERLWDYGM SSSPHVLRNR AQSGSVPQFK

1151 KVVFQEFTDG SFTQPLYRGE LNEHLGLLGP YIRAEVEDNI MVTFRNQASR

1201 PYSFYSSLIS YEEDQRQGAE PRKNFVKPNE TKTYFWKVQH HMAPTKDEFD

1251 CKAWAYFSDV DLEKDVHSGL IGPLLVCHTN TLNPAHGRQV TVQEFALFFT
```

```
1301 IFDETKSWYF TENMERNCRA PCNIQMEDPT FKENYRFHAI NGYIMDTLPG

1351 LVMAQDQRIR WYLLSMGSNE NIHSIHFSGH VFTVRKKEEY KMALYNLYPG

1401 VFETVEMLPS KAGIWRVECL IGEHLHAGMS TLFLVYSNKC QTPLGMASGH

1451 IRDFQITASG QYGQWAPKLA RLHYSGSINA WSTKEPFSWI KVDLLAPMII

1501 HGIKTQGARQ KFSSLYISQF IIMYSLDGKK WQTYRGNSTG TLMVFFGNVD

1551 SSGIKHNIFN PPIIARYIRL HPTHYSIRST LRMELMGCDL NSCSMPLGME

1601 SKAISDAQIT ASSYFTNMFA TWSPSKARLH LQGRSNAWRP QVNNPKEWLQ

1651 VDFQKTMKVT GVTTQGVKSL LTSMYVKEFL ISSSQDGHQW TLFFQNGKVK

1701 VFQGNQDSFT PVVNSLDPPL LTRYLRIHPQ SWVHQIALRM EVLGCEAQDL

1751 YDKTHTCPPC PAPELLGGPS VFLFPPKPKD TLMISRTPEV TCVVVDVSHE

1801 DPEVKFNWYV DGVEVHNAKT KPREEQYNST YRVVSVLTVL HQDWLNGKEY

1851 KCKVSNKALP APIEKTISKA KGQPREPQVY TLPPSRDELT KNQVSLTCLV

1901 KGFYPSDIAV EWESNGQPEN NYKTTPPVLD SDGSFFLYSK LTVDKSRWQQ

1951 GNVFSCSVMH EALHNHYTQK SLSLSPGK*
```

FVIII 263 Nucleotide Sequence (IHH Triple Mutant) (SEQ ID NO: 156)

```
   1 ATGCA AATAG AGCTC TCCAC CTGCT TCTTT CTGTG CCTTT TGCGA TTCTG

51 CTTTA GTGCC ACCAG AAGAT ACTAC CTGGG TGCAG TGGAA CTGTC ATGGG

101 ACTAT ATGCA AGGCG CGCCA ACATC AGAGA GCGCC ACCCC TGAAA GTGGT

151 CCCGG GAGCG AGCCA GCCAC ATCTG GGTCG GAAAC GCCAG GCACA GTGAA

201 GTCTG CAACT CCCGA GTCCG GACCT GGCTC CGAGC CTGCC ACTAG CGGCT

251 CCGAG ACTCC GGGAA CTTCC GAGAG CGCTA CACCA GAAAG CGGAC CCGGA

301 ACCAG TACCG AACCT AGCGA GGGCT CTGCT CCGGG CAGCC CAGCC GGCTC

351 TCCTA CATCC ACGGA GGAGG CACTT CCGAT CCGCC ACCCC GGA GTCAG

401 GGCCA GGATC TGAAC CCGCT ACCTC AGGCA GTGAG ACGCC AGGAA CGAGC

451 GAGTC CGCTA CACCG GAGAG TGGGC CAGGG AGCCC TGCTG ATCT CCTAC

501 GTCCA CTGAG GAAGG GTCAC CAGCG GCTC GCCCA CCAGC ACTGA AGAAG

551 GTGCC TCGAG CAGTG ATCTC GGTGA CTGC CTGTG GACGC AAGAT TTCCT

601 CCTAG AGTGC AAAA TCTTT TCCAT TCAAC CCTC AGTCG TGTAC AAAAA

651 GACTC TGTTT GTAGA ATTCA CGGAT CACCT TTTCA ACATC GCTAA GCCAA

701 GGCCA CCCTG GATGG GTCTG CTAGG TCCTA CCATC CAGGC TGAGG TTTAT

751 GATAC AGTGG TCATT ACACT TAAGA ACATG GCTTC CCATC CTGTC AGTCT

801 TCATG CTGTT GGTGT ATCCT ACTGG AAAGC TTCTG AGGGA GCTGA ATATG

851 ATGAT CAGAC CAGTC AAAGG GAGAA AGAAG ATGAT AAAGT CTTCC CTGGT

901 GGAAG CCATA CATAT GTCTG GCAGG TCCTG AAAGA GAATG GTCCA ATGGC

951 CTCTG ACCCA CTGTG CCTTA CCTAC TCATA TCTTT CCAT GTGGA CCTGG

1001 TAAAA GACTT GAATT CAGGC CTCAT GGAGC CCTA CTAGT ATGTA GAGAA

1051 GGGAG TCTGG CCAAG GAAAA GACAC AGACC TTGCA CAAAT TTATA CTACT

1101 TTTTG CTGTA TTTGA TGAAG GGAAA AGTTG GCACT CAGAA ACAAA GAACT
```

-continued

```
1151 CCTTG ATGCA GGATA GGGAT GCTGC ATCTG CTCGG GCCTG GCCTA AAATG

1201 CACAC AGTCA ATGGT TATGT AAACA GGTCT CTGCC AGGTC TGATT GGATG

1251 CCACA GGAAA TCAGT CTATT GGCAT GTGAT TGGAA TGGGC ACCAC TCCTG

1301 AAGTG CACTC AATAT TCCTC GAAGG TCACA CATTT CTTGT GAGGA ACCAT

1351 CGCCA GGCTA GCTTG GAAAT CTCGC CAATA ACTTT CCTTA CTGCT CAAAC

1401 ACTCT TGATG GACCT TGGAC AGTTT CTACT GTTTT GTCAT ATCTC TTCCC

1451 ACCAA CATGA TGGCA TGGAA GCTTA TGTCA AGTA GACAG CTGTC CAGAG

1501 GAACC CCAAC TACGA ATGAA AAATA ATGAA GAAGC GGAAG ACTAT GATGA

1551 TGATC TTACT GATTC TGAAA TGGAT GTGGT CAGGT TTGAT GATGA CAACT

1601 CTCCT TCCTT TATCC AAATT CGCTC AGTTG CCAAG AAGCA TCCTA AAACT

1651 TGGGT ACATT ACATT GCTGC TGAAG AGGAG GACTG GGACT ATGCT CCCTT

1701 AGTCC TCGCC CCCGA TGACA GAAGT TATAA AAGTC AATAT TTGAA CAATG

1751 GCCCT CAGCG GATTG GTAGG AAGTA CAAAA AAGTC CGATT TATGG CATAC

1801 ACAGA TGAAA CCTTT AAGAC TCGTG AAGCT ATTCA GCATG AATCA GGAAT

1851 CTTGG GACCT TTACT TTATG GGGAA GTTGG AGACA CACTG TTGAT TATAT

1901 TTAAG AATCA AGCAA GCAGA CCATA TAACA TCTAC CCTCA CGGAA TCACT

1951 GATGT CCGTC CTTTG TATTC AAGGA GATTA CCAAA AGGTG TAAAA CATTT

2001 GAAGG ATTTT CCAAT TCTGC CAGGA GAAAT ATTCA AATAT AAATG GACAG

2051 TGACT GTAGA AGATG GGCCA ACTAA ATCAG ATCCT CGGTG CCTGA CCCGC

2101 TATTA CTCTA GTTTC GTTAA TATGG AGAGA GATCT AGCTT CAGGA CTCAT

2151 TGGCC CTCTC CTCAT CTGCT ACAAA GAATC TGTAG ATCAA GAGG AAACC

2201 AGATA ATGTC AGACA AGAGG AATGT CATCC TGTTT TCTGT ATTTG ATGAG

2251 AACCG AAGCT GGTAC CTCAC AGAGA ATATA CAACG CTTTC TCCCC AATCC

2301 AGCTG GAGTG CAGCT TGAGG ATCCA GAGTT CCAAG CCTCC AACAT CATGC

2351 ACAGC ATCAA TGGCT ATGTT TTTGA TAGTT TGCAG TTGTC AGTTT GTTTG

2401 CATGA GGTGG CATAC TGGTA CATTC TAAGC ATTGG AGCAC AGACT GACTT

2451 CCTTT CTGTC TTCTT CTCTG GATAT ACCTT CAAAC ACAAA ATGGT CTATG

2501 AAGAC ACACT CACCC TATTC CCATT CTCAG GAGAA ACTGT CTTCA TGTCG

2551 ATGGA AAACC CAGGT CTATG GATTC TGGGG TGCCA CAACT CAGAC TTTCG

2601 GAACA GAGGC ATGAC CGCCT TACTG AAGGT TTCTA GTTGT GACAA GAACA

2651 CTGGT GATTA TTACG AGGAC AGTTA TGAAG ATATT TCAGC ATACT TGCTG

2701 AGTAA AAACA ATGCC ATTGA ACCAA GAAGC TTCTC TCAAA ACGGC GCGCC

2751 AGGTA CCTCA GAGTC TGCTA CCCCC GAGTC AGGGC CAGGA TCAGA GCCAG

2801 CCACC TCCGG GTCTG AGACA CCCGG GACTT CCGAG AGTGC ACCC CTGAG

2851 TCCGG ACCCG GGTCC GAGCC CGCCA CTTCC GGCTC CGAAA CTCCC GGCAC

2901 AAGCG AGAGC GCTAC CCCAG AGTCA GGACC AGGAA CATCT ACAGA GCCCT

2951 CTGAA GGCTC CGCTC CAGGG TCCCC AGCCG GCAGT CCCAC TAGCA CCGAG

3001 GAGGG AACCT CTGAA AGCGC ACAC CCGAA TCAGG GCCAG GGTCT GAGCC

3051 TGCTA CCAGC GGCAG CGAGA CACCA GGCAC CTCTG AGTCC GCCAC ACCAG

3101 AGTCC GGACC CGGAT CTCCC GCTGG GAGCC CCACC TCCAC TGAGG AGGGA

3151 TCTCC TGCTG GCTCT CCAAC ATCTA CTGAG GAAGG TACCT CAACC GAGCC
```

```
3201 ATCCG AGGGA TCAGC TCCCG GCACC TCAGA GTCGG CAACC CCGGA GTCTG
3251 GACCC GGAAC TTCCG AAAGT GCCAC ACCAG AGTCC GGTCC CGGGA CTTCA
3301 GAATC AGCAA CACCC GAGTC CGGCC CTGGG TCTGA ACCCG CCACA AGTGG
3351 TAGTG AGACA CCAGG ATCAG AACCT GCTAC CTCAG GGTCA GAGAC ACCCG
3401 GATCT CCGGC AGGCT CACCA ACCTC CACTG AGGAG GGCAC CAGCA CAGAA
3451 CCAAG CGAGG GCTCC GCACC CGGAA CAAGC ACTGA ACCCA GTGAG GGTTC
3501 AGCAC CCGGC TCTGA GCCGG CCACA GTGGC AGTGA GACA CCCGG CACTT
3551 CAGAG AGTGC CACCC CCGAG AGTGG CCCAG GCACT AGTAC CGAGC CCTCT
3601 GAAGG CAGTG CGCCA GCCTC GAGCC CACCA GTCTT GAAAC GCCAT CAAGC
3651 TGAAA TAACT CGTAC TACTC TTCAG TCAGA TCAAG AGGAA ATCGA TTATG
3701 ATGAT ACCAT ATCAG TTGAA ATGAA GAAGG AAGAT TTTGA CATTT ATGAT
3751 GAGGA TGAAA ATCAG AGCCC CCGCA GCTTT CAAAA GAAAA CACGA CACTA
3801 TTTTA TTGCT GCAGT GGAGA GGCTC TGGGA TTATG GGATG AGTAG CTCCC
3851 CACAT GTTCT AAGAA ACAGG GCTCA GAGTG GCAGT GTCCC TCAGT TCAAG
3901 AAAGT TGTTT CCAG GAATT TACTG ATGGC TCCTT TACTC AGCCC TTATA
3951 CCGTG GAGAA CTAAA TGAAC ATTTG GGACT CCTGG GGCCA TATAT AAGAG
4001 CAGAA GTTGA AGATA ATATC ATGGT AACTT TCAGA AATCA GGCCT CTCGT
4051 CCCTA TTCCT TCTAT TCTAG CCTTA TTTCT TATGA GGAAG ATCAG AGGCA
4101 AGGAG CAGAA CCTAG AAAAA ACTTT GTCAA GCCTA ATGAA ACCAA AACTT
4151 ACTTT TGGAA AGTGC AACAT CATAT GGCAC CCACT AAAGA TGAGT TTGAC
4201 TGCAA AGCCT GGGCT TATTT CTCTG ATGTT GACCT GGAAA AAGAT GTGCA
4251 CTCAG GCCTG ATTGG ACCCC TTCTG GTCTG CCACA CTAAC ACACT GAACC
4301 CTGCT CATGG GAGAC AAGTG ACAGT ACAGG AATTT GCTCT GTTTT TCACC
4351 ATCTT TGATG AGACC AAAAG CTGGT ACTTC ACTGA AAATA TGGAA AGAAA
4401 CTGCA GGGCT CCCTG CAATA TCCAG ATGGA AGATC CCACT TTTAA AGAGA
4451 ATTAT CGCTT CCATG CAATC AATGG CTACA TAATG GATAC ACTAC CTGGC
4501 TTAGT AATGG CTCAG GATCA AAGGA TTCGA TGGTA TCTGC TCAGC ATGGG
4551 CAGCA ATGAA ACAT CCATT CTATT CATTT CAGTG GACAT GTGTT CACTG
4601 TACGA AAAAA AGAGG AGTAT AAAAT GGCAC TGTAC AATCT CTATC CAGGT
4651 GTTTT TGAGA CAGTG GAAAT GTTAC CATCC AAAGC TGGAA TTTGG CGGGT
4701 GGAAT GCCTT ATTGG CGAGC ATCTA CATGC TGGGA TGAGC ACACT TTTTC
4751 TGGTG TACAG CAATA AGTGT CAGAC TCCCC TGGGA ATGGC TTCTG GACAC
4801 ATTAG AGATT TTCAG ATTAC AGCTT CAGGA CAATA TGGAC AGTGG GCCCC
4851 AAAGC TGGCC AGACT TCATT ATTCC GGATC AATCA ATGCC TGGAG CACCA
4901 AGGAG CCCTT TTCTT GGATC AAGGT GGATC TGTTG GCACC AATGA TTATT
4951 CACGG CATCA AGACC CAGGG TGCCC GTCAG AAGTT CTCCA GCCTC TACAT
5001 CTCTC AGTTT ATCAT CATGT ATAGT CTTGA TGGGA GAAG TGGCA GACTT
5051 ATCGA GGAAA TTCCA CTGGA ACCTT AATGG TCTTC TTTGG CAATG TGGAT
5101 TCATC TGGGA TAAAA CACAA TATTT TTAAC CCTCC AATTA TTGCT CGATA
5151 CATCC GTTTG CACCC AACTC ATTAT AGCAT TCGCA GCACT CTTCG CATGG
```

-continued

```
5201 AGTTG ATGGG CTGTG ATTTA AATAG TTGCA GCATG CCATT GGGAA TGGAG

5251 AGTAA AGCAA TATCA GATGC ACAGA TTACT GCTTC ATCCT ACTTT ACCAA

5301 TATGT TTGCC ACCTG GTCTC CTTCA AAAGC TCGAC TTCAC CTCCA AGGGA

5351 GGAGT AATGC CTGGA GACCT CAGGT GAATA ATCCA AAAGA GTGGC TGCAA

5401 GTGGA CTTCC AGAAG ACAAT GAAAG TCACA GGAGT AACTA CTCAG GGAGT

5451 AAAAT CTCTG CTTAC CAGCA TGTAT GTGAA GGAGT TCCTC ATCTC CAGCA

5501 GTCAA GATGG CCATC AGTGG ACTCT CTTTT TTCAG AATGG CAAAG TAAAG

5551 GTTTT TCAGG GAAAT CAAGA CTCCT TCACA CCTGT GGTGA ACTCT CTAGA

5601 CCCAC CGTTA CTGAC TCGCT ACCTT CGAAT TCACC CCCAG AGTTG GGTGC

5651 ACCAG ATTGC CCTGA GGATG GAGGT TCTGG GCTGC GAGGC ACAGG ACCTC

5701 TACGA CAAAA CTCAC ACATG CCCAC CGTGC CCAGC TCCAG AACTC CTGGG

5751 CGGAC CGTCA GTCTT CCTCT TCCCC CCAAA ACCCA AGGAC ACCCT CATGG

5801 CCTCC CGGAC CCCTG AGGTC ACATG CGTGG TGGTG GACGT GAGCC ACGAA

5851 GACCC TGAGG TCAAG TTCAA CTGGT ACGTG GACGG CGTGG AGGTG CATAA

5901 TGCCA AGACA AAGCC GCGGG AGGAG CAGTA CAACA GCACG TACCG TGTGG

5951 TCAGC GTCCT CACCG TCCTG GCCCA GGACT GGCTG AATGG CAAGG AGTAC

6001 AAGTG CAAGG TCTCC AACAA AGCCC TCCCA GCCCC CATCG AGAAA ACCAT

6051 CTCCA AAGCC AAAGG GCAGC CCCGA GAACC ACAGG TGTAC ACCCT GCCCC

6101 CATCC CGCGA TGAGC TGACC AAGAA CCAGG TCAGC CTGAC CTGCC TGGTC

6151 AAAGG CTTCT ATCCC AGCGA CATCG CCGTG GAGTG GGAGA GCAAT GGGCA

6201 GCCGG AGAAC AACTA CAAGA CCACG CCTCC CGTGT TGGAC TCCGA CGGCT

6251 CCTTC TTCCT CTACA GCAAG CTCAC CGTGG ACAAG AGCAG GTGGC AGCAG

6301 GGGAA CGTCT TCTCA TGCTC CGTGA TGCAT GAGGC TCTGC ACAAC GCCTA

6351 CACGC AGAAG AGCCT CTCCC TGTCT CCGGG TAAAT GA
```

<40>

FVIII 263 Protein Sequence (IHH Triple Mutant) (SEQ ID NO: 157)

```
  1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGSPAGSPTS TEEGTSESAT PESGPGSEPA TSGSETPGTS

151 ESATPESGPG SPAGSPTSTE EGSPAGSPTS TEEGASSSDL GELPVDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR
```

```
 701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTSTEEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS TEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCHTN TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMASRTPEV TCVVVDVSHE

1951 DPEVKFNWYV DGVEVHNAKT KPREEQYNST YRVVSVLTVL AQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNAYTQK SLSLSPGK*
```

FVIII 282 Nucleotide Sequence (SEQ ID NO: 158)

```
  1 ATGCA AATAG AGCTC TCCAC CTGCT CTTTT CTGTG CCTTT TGCGA TTCTG

51 CTTTA GTGCC ACCAG AAGAT ACTAC TGGGT GCAG TGGAA CTGTC ATGGG

101 ACTAT ATGCA AAGTG ATCTC GGTGA GCTGC TGTGT GACGC AAGAT TTCCT

151 CCTAG AGTGC CAAAA TCTTT TCCAT TCAAC CCTCA GTCG TGTAC AAAAA

201 GACTC TGTTT GTAGA ATTCA CGGAT CACCT TTTCA ACATC GCTAA GCCAA

251 GGCCA CCCTG GATGG GTCTG CTAGG TCCTA CCATC CAGGC TGAGG TTTAT

301 GATAC AGTGG TCATT ACACT TAAGA ACATG GCTTC CCATC CTGTC AGTCT

351 TCATG CTGTT GGTGT ATCCT ACTGG AAAGC TTCTG AGGGA GCTGA ATATG

401 ATGAT CAGAC CAGTC AAAGG GAGAA AGAAG ATGAT AAAGT CTTCC CTGGT
```

-continued
```
 451 GGAAG CCATA CATAT GTCTG GCAGG TCCTG AAAGA GAATG GTCCA ATGGC

501 CTCTG ACCCA CTGTG CCTTA CCTAC TCATA TCTTT CTCAT GTGGA CCTGG

551 TAAAA GACTT GAATT CAGGC CTCAT GGAGC CCCTA CTAGT ATGTA GAGAA

601 GGGAG TCTGG CCAAG GAAAA GACAC AGACC TTGCA CAAAT TTATA CTACT

651 TTTTG CTGTA TTTGA TGAAG GGAAA AGTTG GCACT CAGAA ACAAA GAACT

701 CCTTG ATGCA GGATA GGGAT GCTGC ATCTG CTCGG GCCTG GCCTA AAATG

751 CACAC AGTCA ATGGT TATGT AAACA GGTCT CTGCC AGGTC TGATT GGATG

801 CCACA GGAAA TCAGT CTATT GGCAT GTGAT TGGAA TGGGC ACCAC TCCTG

851 AAGTG CACTC AATAT CCTCG AAGG TCACA CATTT CTTGT GAGGA ACCAT

901 CGCCA GGCTA GCTTG GAAAT CTCGC CAATA ACTTT CCTTA CTGCT CAAAC

951 ACTCT TGATG GACCT TGGAC AGTTT CTACT GTTTT GTCAT ATCTC TTCCC

1001 ACCAA CATGA TGGCA TGGAA GCTTA TGTCA AAGTA GACAG CTGTC CAGAG

1051 GAACC CCAAC TACGA ATGAA AAATA ATGAA GAAGC GGAAG ACTAT GATGA

1101 TGATC TTACT GATTC TGAAA TGGAT GTGGT CAGGT TTGAT GATGA CAACT

1151 CTCCT TCCTT TATCC AAATT CGCTC AGTTG CCAAG AAGCA TCCTA AAACT

1201 TGGGT ACATT ACATT GCTGC TGAAG AGGAG GACTG GGACT ATGCT CCCTT

1251 AGTCC TCGCC CCCGA TGACA GAAGT TATAA AAGTC AATAT TTGAA CAATG

1301 GCCCT CAGCG GATTG GTAGG AAGTA CAAAA AAGTC CGATT TATGG CATAC

1351 ACAGA TGAAA CCTTT AAGAC TCGTG AAGCT ATTCA GCATG AATCA GGAAT

1401 CTTGG GACCT TTACT TTATG GGAAG TTGGA GACA CACTG TTGAT TATAT

1451 TTAAG AATCA AGCAA GCAGA CCATA TAACA TCTAC CCTCA CGGAA TCACT

1501 GATGT CCGTC CTTTG TATTC AAGGA GATTA CCAAA AGGTG TAAAA CATTT

1551 GAAGG ATTTT CCAAT TCTGC CAGGA GAAAT ATTCA AATAT AAATG GACAG

1601 TGACT GTAGA AGATG GGCCA ACTAA ATCAG ATCCT CGGTG CCTGA CCCGC

1651 TATTA CTCTA GTTTC GTTAA TATGG AGAGA GATCT AGCTT CAGGA CTCAT

1701 TGGCC CTCTC CTCAT CTGCT ACAAA GAATC TGTAG ATCAA AGAGG AAACC

1751 AGATA ATGTC AGACA GAGG AATGT CATCC TGTTT CTGT ATTTG ATGAG

1801 AACCG AAGCT GGTAC CTCAC AGAGA ATATA CAACG CTTTC TCCCC AATCC

1851 AGCTG GAGTG CAGCT TGAGG ATCCA GAGTT CCAAG CCTCC AACAT CATGC

1901 ACAGC ATCAA TGGCT ATGTT TTTGA TAGTT TGCAG TTGTC AGTTT GTTTG

1951 CATGA GGTGG CATAC TGGTA CATTC TAAGC ATTGG AGCAC AGACT GACTT

2001 CCTTT CTGTC TTCTT CTCTG GATAT ACCTT CAAAC ACAAA ATGGT CTATG

2051 AAGAC ACACT CACCC TATTC CCATT CTCAG GAGAA ACTGT CTTCA TGTCG

2101 ATGGA AAACC CAGGT CTATG GATTC TGGGG TGCCA CAACT CAGAC TTTCG

2151 GAACA GAGGC ATGAC CGCCT TACTG AAGGT TTCTA GTTGT GACAA GAACA

2201 CTGGT GATTA TTACG AGGAC AGTTA TGAAG ATATT TCAGC ATACT GCTGG

2251 AGTAA AAACA ATGCC ATTGA ACCAA GAAGC TTCTC TCAAA ACGGC GCGCC

2301 AACAT CAGAG AGCGC CACCC CTGAA GTGGG TCCCG GGAGC GAGCC AGCCA

2351 CATCT GGGTC GGAAA CGCCA GGCAC AAGTG AGTCT GCAAC TCCCG AGTCC

2401 GGACC TGGCT CCGAG CCTGC CACTA GCGGC TCCGA GACTC CGGGA ACTTC

2451 CGAGA GCGCT ACACC AGAAA GCGGA CCCGG AACCA GTACC GAACC TAGCG
```

```
2501 AGGGC TCTGC TCCGG GCAGC CCAGC CGGCT CTCCT ACATC CACGG AGGAG

2551 GGCAC TTCCG AATCC GCCAC CCCGG AGTCA GGGCC AGGAT CTGAA CCCGC

2601 TACCT CAGGC AGTGA GACGC CAGGA ACGAG CGAGT CCGCT ACACC GGAGA

2651 GTGGG CCAGG GAGCC CTGCT GGATC TCCTA CGTCC ACTGA GGAAG GGTCA

2701 CCAGC GGGCT CGCCC ACCAG CACTG AAGAA GGTGC CTCGA GCCCA CCAGT

2751 CTTGA AACGC ATCA AGCTG AAATA ACTCG TACTA CTCTT CAGTC AGATC

2801 AAGAG GAAAT CGATT ATGAT GATAC ATAT CAGTT GAAAT GAAGA AGGAA

2851 GATTT TGACA TTTAT GATGA GGATG AAAAT CAGAG CCCCC GCAGC TTTCA

2901 AAAGA AAACA CGACA CTATT TTATT GCTGC AGTGG AGAGG CTCTG GGATT

2951 ATGGG ATGAG TAGCT CCCCA CATGT TCTAA GAAAC AGGGC TCAGA GTGGC

3001 AGTGT CCCTC AGTTC AAGAA AGTTG TTTTC CAGGA ATTTA CTGAT GGCTC

3051 CTTTA CTCAG CCCTT ATACC GTGGA GAACT AAATG AACAT TTGGG ACTCC

3101 TGGGG CCATA TATAA GAGCA GAAGT TGAAG ATAAT ATCAT GGTAA CTTTC

3151 AGAAA TCAGG CCTCT CGTCC CTATT CCTTC TATTC TAGCC TTATT TCTTA

3201 TGAGG AAGAT CAGAG GCAAG GAGCA GAACC TAGAA AAAAC TTTGT CAAGC

3251 CTAAT GAAAC CAAAA CTTAC TTTTG GAAAG TGCAA CATCA TATGG CACCC

3301 ACTAA AGATG AGTTT GACTG CAAAG CCTGG GCTTA TTTCT CTGAT GTTGA

3351 CCTGG AAAAA GATGT GCACT CAGGC CTGAT TGGAC CCCTT CTGGT CTGCC

3401 ACACT AACAC ACTGA ACCCT GCTCA TGGGA GACAA GTGAC AGTAC AGGAA

3451 TTTGC TCTGT TTTTC ACCAT CTTTG ATGAG ACCAA AAGCT GGTAC TTCAC

3501 TGAAA ATATG GAAAG AAACT GCAGG GCTCC CTGCA ATATC CAGAT GGAAG

3551 ATCCC ACTTT TAAAG AGAAT TATCG CTTCC ATGCA ATCAA TGGCT ACATA

3601 ATGGA TACAC TACCT GGCTT AGTAA TGGCT CAGGA TCAAA GGATT CGATG

3651 GTATC TGCTC AGCAT GGGCA GCAAT GAAAA CATCC ATTCT ATTCA TTTCA

3701 GTGGA CATGT GTTCA CTGTA CGAAA AAAAG AGGAG TATAA AATGG CACTG

3751 TACAA TCTCT ATCCA GGTGT TTTTG AGACA GTGGA AATGT TACCA TCCAA

3801 AGCTG GAATT TGGCG GGTGG AATGC TTATT GGCG AGCAT CTACA TGCTG

3851 GGATG AGCAC ACTTT TTCTG GTGTA CAGCA ATAAG TGTCA GACTC CCCTG

3901 GGAAT GGCTT CTGGA CACAT TAGAG ATTTT CAGAT TACAG CTTCA GGACA

3951 ATATG GACAG TGGGC CCCAA AGCTG GCCAG ACTTC ATTAT TCCGG ATCAA

4001 TCAAT GCCTG GAGCA CCAAG GAGCC CTTTT CTTGG ATCAA GGTGG ATCTG

4051 TTGGC ACCAA TGATT ATTCA CGGCA TCAAG ACCCA GGGTG CCCGT CAGAA

4101 GTTCT CCAGC CTCTA CATCT CTCAG TTTAT CATCA TGTAT AGTCT TGATG

4151 GGAAG AAGTG GCAGA CTTAT CGAGG AAATT CCACT GGAAC CTTAA TGGTC

4201 TTCTT TGGCA ATGTG GATTC ATCTG GGATA AAACA CAATA TTTTT AACCC

4251 TCCAA TTATT GCTCG ATACA TCCGT TTGCA CCCAA CTCAT TATAG CATTC

4301 GCAGC ACTCT TCGCA TGGAG TTGAT GGGCT GTGAT TTAAA TAGTT GCAGC

4351 ATGCC ATTGG GAATG GAGAG TAAAG CAATA TCAGA TGCAC AGATT ACTGC

4401 TTCAT CCTAC TTTAC CAATA TGTTT GCCAC CTGGT CTCCT TCAAA AGCTC

4451 GACTT CACCT CCAAG GGAGG AGTAA TGCCT GGAGA CCTCA GGTGA ATAAT
```

-continued

```
4501 CCAAA AGAGT GGCTG CAAGT GGACT TCCAG AAGAC AATGA AAGTC ACAGG

4551 AGTAA CTACT CAGGG AGTAA AATCT CTGCT TACCA GCATG TATGT GAAGG

4601 AGTTC CTCAT CTCCA GCAGT CAAGA TGGCC ATCAG TGGAC TCTCT TTTTT

4651 CAGAA TGGCA AAGTA AAGGT TTTTC AGGGA AATCA AGACT CCTTC ACACC

4701 TGTGG TGAAC TCTCT AGACC CACCG TTACT GACTC GCTAC CTTCG AATTC

4751 ACCCC CAGAG TTGGG TGCAC CAGAT GCCCT GAGG ATGGA GGTTC TGGGC

4801 TGCGA GGCAC AGGAC CTCTA CGACA AAACT CACAC ATGCC CACCG TGCCC

4851 AGCTC CAGAA CTCCT GGGCG GACCG TCAGT CTTCC TCTTC CCCCC AAAAC

4901 CCAAG GACAC CCTCA TGATC TCCCG GACCC CTGAG GTCAC ATGCG TGGTG

4951 GTGGA CGTGA GCCAC GAAGA CCCTG AGGTC AAGTT CAACT GGTAC GTGGA

5001 CGGCG TGGAG GTGCA TAATG CCAAG ACAAA GCCGC GGGAG GAGCA GTACA

5051 ACAGC ACGTA CCGTG TGGTC AGCGT CCTCA CCGTC CTGCA CCAGG ACTGG

5101 CTGAA TGGCA AGGAG TACAA GTGCA AGGTC TCCAA CAAAG CCCTC CCAGC

5151 CCCCA TCGAG AAAAC CATCT CCAAA GCCAA AGGGC AGCCC CGAGA ACCAC

5201 AGGTG TACAC CCTGC CCCCA TCCCG GGATG AGCTG ACCAA GAACC AGGTC

5251 AGCCT GACCT GCCTG GTCAA AGGCT TCTAT CCCAG CGACA TCGCC GTGGA

5301 GTGGG AGAGC AATGG GCAGC CGGAG AACAA CTACA AGACC ACGCC TCCCG

5351 TGTTG GACTC CGACG GCTCC TTCTT CCTCT ACAGC AAGCT CACCG TGGAC

5401 AAGAG CAGGT GGCAG CAGGG GAACG TCTTC TCATG CTCCG TGATG CATGA

5451 GGCTC TGCAC AACCA CTACA CGCAG AAGAG CCTCT CCCTG TCTCC GGGTA

5501 AATGA
```

FVIII 282 Protein Sequence (SEQ ID NO: 159)

```
  1  MQIELSTCFF LCLLRFCFSA TRRYYLGAVE LSWDYMQSDL GELPVDARFP

51  PRVPKSFPFN TSVVYKKTLF VEFTDHLFNI AKPRPPWMGL LGPTIQAEVY

101  DTVVITLKNM ASHPVSLHAV GVSYWKASEG AEYDDQTSQR EKEDDKVFPG

151  GSHTYVWQVL KENGPMASDP LCLTYSYLSH VDLVKDLNSG LIGALLVCRE

201  GSLAKEKTQT LHKFILLFAV FDEGKSWHSE TKNSLMQDRD AASARAWPKM

251  HTVNGYVNRS LPGLIGCHRK SVYWHVIGMG TTPEVHSIFL EGHTFLVRNH

301  RQASLEISPI TFLTAQTLLM DLGQFLLFCH ISSHQHDGME AYVKVDSCPE

351  EPQLRMKNNE EAEDYDDDLT DSEMDVVRFD DDNSPSFIQI RSVAKKHPKT

401  WVHYIAAEEE DWDYAPLVLA PDDRSYKSQY LNNGPQRIGR KYKKVRFMAY

451  TDETFKTREA IQHESGILGP LLYGEVGDTL LIIFKNQASR PYNIYPHGIT

501  DVRPLYSRRL PKGVKHLKDF PILPGEIFKY KWTVTVEDGP TKSDPRCLTR

551  YYSSFVNMER DLASGLIGPL LICYKESVDQ RGNQIMSDKR NVILFSVFDE

601  NRSWYLTENI QRFLPNPAGV QLEDPEFQAS NIMHSINGYV FDSLQLSVCL

651  HEVAYWYILS IGAQTDFLSV FFSGYTFKHK MVYEDTLTLF PFSGETVFMS

701  MENPGLWILG CHNSDFRNRG MTALLKVSSC DKNTGDYYED SYEDISAYLL

751  SKNNAIEPRS FSQNGAPTSE SATPESGPGS EPATSGSETP GTSESATPES

801  GPGSEPATSG SETPGTSESA TPESGPGTST EPSEGSAPGS PAGSPTSTEE

851  GTSESATPES GPGSEPATSG SETPGTSESA TPESGPGSPA GSPTSTEEGS
```

```
 901 PAGSPTSTEE GASSPPVLKR HQAEITRTTL QSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE

1151 FALFFTIFDE TKSWYFTENM ERNCRAPCNI QMEDPTFKEN YRFHAINGYI

1201 MDTLPGLVMA QDQRIRWYLL SMGSNENIHS IHFSGHVFTV RKKEEYKMAL

1251 YNLYPGVFET VEMLPSKAGI WRVECLIGEH LHAGMSTLFL VYSNKCQTPL

1301 GMASGHIRDF QITASGQYGQ WAPKLARLHY SGSINAWSTK EPFSWIKVDL

1351 LAPMIIHGIK TQGARQKFSS LYISQFIIMY SLDGKKWQTY RGNSTGTLMV

1401 FFGNVDSSGI KHNIFNPPII ARYIRLHPTH YSIRSTLRME LMGCDLNSCS

1451 MPLGMESKAI SDAQITASSY FTNMFATWSP SKARLHLQGR SNAWRPQVNN

1501 PKEWLQVDFQ KTMKVTGVTT QGVKSLLTSM YVKEFLISSS QDGHQWTLFF

1551 QNGKVKVFQG NQDSFTPVVN SLDPPLLTRY LRIHPQSWVH QIALRMEVLG

1601 CEAQDLYDKT HTCPPCPAPE LLGGPSVFLF PPKPKDTLMI SRTPEVTCVV

1651 VDVSHEDPEV KFNWYVDGVE VHNAKTKPRE EQYNSTYRVV SVLTVLHQDW

1701 LNGKEYKCKV SNKALPAPIE KTISKAKGQP REPQVYTLPP SRDELTKNQV

1751 SLTCLVKGFY PSDIAVEWES NGQPENNYKT TPPVLDSDGS FFLYSKLTVD

1801 KSRWQQGNVF SCSVMHEALH NHYTQKSLSL SPGK*
```

FVIII 283 Nucleotide Sequence (FVIII 169 with IHH Triple Mutation) (SEQ ID NO: 160)

```
   1 ATGCA AATAG AGCTC TCCAC CTGCT TCTTT CTGTG CCTTT GCGA TTCTG

51 CTTTA GTGCC ACCAG AAGAT ACTAC CTGGG TGCAG TGGAA CTGTC ATGGG

101 ACTAT ATGCA AAGTG ATCTC GGTGA GCTGC CTGTG GACGC AAGAT TCCT

151 CCTAG AGTGC AAAA TCTTT TCCAT CAACC CTCA GTCG GTAC AAAA

201 GACTC TGTTT GTAGA ATTCA CGGAT CACCT TTTCA ACATC GCTAA GCCAA

251 GGCCA CCCTG GATGG GTCTG CTAGG TCCTA CCATC CAGGC TGAGG TTTAT

301 GATAC AGTGG TCATT ACACT TAAGA ACATG GCTTC CCATC CTGTC AGTCT

351 TCATG CTGTT GGTGT ATCCT ACTGG AAAGC TTCTG AGGGA GCTGA ATATG

401 ATGAT CAGAC CAGTC AAAGG GAGAA AGAAG ATGAT AAAGT CTTCC CTGGT

451 GGAAG CCATA CATAT GTCTG GCAGG TCCTG AAAGA GAATG GTCCA ATGGC

501 CTCTG ACCCA CTGTG CCTTA CCTAC TCATA TCTTT CTCAT GTGGA CCTGG

551 TAAAA GACTT GAATT CAGGC CTCAT GGAGC CCTA CTAGT ATGTA GAGAA

601 GGGAG TCTGG CCAAG GAAAA GACAC AGACC TTGCA CAAAT TTATA CTACT

651 TTTTG CTGTA TTTGA TGAAG GGAAA AGTTG GCACT CAGAA ACAAA GAACT

701 CCTTG ATGCA GGATA GGGAT GCTGC ATCTG CTCGG GCCTG GCCTA AAATG

751 CACAC AGTCA ATGGT TATGT AAACA GGTCT CTGCC AGGTC TGATT GGATG

801 CCACA GGAAA TCAGT CTATT GGCAT GTGAT TGGAA TGGGC ACCAC TCCTG

851 AAGTG CACTC AATAT CCTC GAAGG TCACA CATTT CTTGT GAGGA ACCAT
```

```
                            -continued
 901 CGCCA GGCTA GCTTG GAAAT CTCGC CAATA ACTTT CCTTA CTGCT CAAAC

951 ACTCT TGATG GACCT TGGAC AGTTT CTACT GTTTT GTCAT ATCTC TTCCC

1001 ACCAA CATGA TGGCA TGGAA GCTTA TGTCA AGTA GACAG CTGTC CAGAG

1051 GAACC CCAAC TACGA ATGAA AAATA ATGAA GAAGC GGAAG ACTAT GATGA

1101 TGATC TTACT GATTC TGAAA TGGAT GTGGT CAGGT TTGAT GATGA CAACT

1151 CTCCT TCCTT TATCC AAATT CGCTC AGTTG CCAAG AAGCA TCCTA AAACT

1201 TGGGT ACATT ACATT GCTGC TGAAG AGGAG GACTG GGACT ATGCT CCCTT

1251 AGTCC TCGCC CCCGA TGACA GAAGT TATAA AAGTC AATAT TTGAA CAATG

1301 GCCCT CAGCG GATTG GTAGG AAGTA CAAAA AAGTC CGATT TATGG CATAC

1351 ACAGA TGAAA CCTTT AAGAC TCGTG AAGCT ATTCA GCATG AATCA GGAAT

1401 CTTGG GACCT TTACT TTATG GGGAA GTTGG AGACA CACTG TTGAT TATAT

1451 TTAAG AATCA AGCAA GCAGA CCATA TAACA TCTAC CCTCA CGGAA TCACT

1501 GATGT CCGTC CTTTG TATTC AAGGA GATTA CCAAA AGGTG TAAAA CATTT

1551 GAAGG ATTTT CCAAT TCTGC CAGGA GAAAT ATTCA AATAT AAATG GACAG

1601 TGACT GTAGA AGATG GGCCA ACTAA ATCAG ATCCT CGGTG CCTGA CCCGC

1651 TATTA CTCTA GTTTC GTTAA TATGG AGAGA GATCT AGCTT CAGGA CTCAT

1701 TGGCC CTCTC CTCAT CTGCT ACAAA GAATC TGTAG ATCAA AGAGG AAACC

1751 AGATA ATGTC AGACA AGAGG AATGT CATCC TGTTT CTGT ATTTG ATGAG

1801 AACCG AAGCT GGTAC CTCAC AGAGA ATATA CAACG CTTTC TCCCC AATCC

1851 AGCTG GAGTG CAGCT TGAGG ATCCA GAGTT CCAAG CCTCC AACAT CATGC

1901 ACAGC ATCAA TGGCT ATGTT TTTGA TAGTT TGCAG TTGTC AGTTT GTTTG

1951 CATGA GGTGG CATAC TGGTA CATTC TAAGC ATTGG AGCAC AGACT GACTT

2001 CCTTT CTGTC TTCTT CTCTG GATAT ACCTT CAAAC ACAAA ATGGT CTATG

2051 AAGAC ACACT CACCC TATTC CCATT CTCAG GAGAA ACTGT CTTCA TGTCG

2101 ATGGA AAACC CAGGT CTATG GATTC TGGGG TGCCA CAACT CAGAC TTTCG

2151 GAACA GAGGC ATGAC CGCCT TACTG AAGGT TTCTA GTTGT GACAA GAACA

2201 CTGGT GATTA TTACG AGGAC AGTTA TGAAG ATATT TCAGC ATACT TGCTG

2251 AGTAA AAACA ATGCC ATTGA ACCAA GAAGC TTCTC TCAAA ACGGC GCGCC

2301 AGGTA CCTCA GAGTC TGCTA CCCCC GAGTC AGGGC CAGGA TCAGA GCCAG

2351 CCACC TCCGG GTCTG AGACA CCCGG GACTT CCGAG AGTGC CACCC CTGAG

2401 TCCGG ACCCG GTCCG AGCCC CGCCA CTTCC GGCTC CGAAA CTCCC GGCAC

2451 AAGCG AGAGC GCTAC CCCAG AGTCA GGACC AGGAA CATCT ACAGA GCCCT

2501 CTGAA GGCTC CGCTC CAGGG TCCCC AGCCG GCAGT CCCAC TAGCA CCGAG

2551 GAGGG AACCT CTGAA AGCGC ACACC CCGAA TCAGG GCCAG GGTCT GAGCC

2601 TGCTA CCAGC GGCAG CGAGA CACCA GGCAC CTCTG AGTCC GCCAC ACCAG

2651 AGTCC GGACC CGGAT CTCCC GCTGG GAGCC CCACC TCCAC TGAGG AGGGA

2701 TCTCC TGCTG GCTCT CCAAC ATCTA CTGAG GAAGG TACCT CAACC GAGCC

2751 ATCCG AGGGA TCAGC TCCCG GCACC TCAGA GTCGG CAACC CCGGA GTCTG

2801 GACCC GGAAC TTCCG AAAGT GCCAC ACCAG AGTCC GGTCC CGGGA CTTCA

2851 GAATC AGCAA CACCC GAGTC CGGCC CTGGG TCTGA ACCCG CCACA AGTGG

2901 TAGTG AGACA CCAGG ATCAG AACCT GCTAC CTCAG GGTCA GAGAC ACCCG
```

-continued

```
2951 GATCT CCGGC AGGCT CACCA ACCTC CACTG AGGAG GGCAC CAGCA CAGAA
3001 CCAAG CGAGG GCTCC GCACC CGGAA CAAGC ACTGA ACCCA GTGAG GGTTC
3051 AGCAC CCGGC TCTGA GCCGG CCACA AGTGG CAGTG AGACA CCCGG CACTT
3101 CAGAG AGTGC CACCC CCGAG AGTGG CCCAG GCACT AGTAC CGAGC CCTCT
3151 GAAGG CAGTG CGCCA GCCTC GAGCC CACCA GTCTT GAAAC GCCAT CAAGC
3201 TGAAA TAACT CGTAC TACTC TTCAG TCAGA TCAAG AGGAA ATCGA TTATG
3251 ATGAT ACCAT ATCAG TTGAA ATGAA GAAGG AAGAT TTTGA CATTT ATGAT
3301 GAGGA TGAAA ATCAG AGCCC CCGCA GCTTT CAAAA GAAAA CACGA CACTA
3351 TTTTA TTGCT GCAGT GGAGA GGCTC TGGGA TTATG GGATG AGTAG CTCCC
3401 CACAT GTTCT AAGAA ACAGG GCTCA GAGTG GCAGT GTCCC TCAGT TCAAG
3451 AAAGT TGTTT CCAG GAATT TACTG ATGGC TCCTT TACTC AGCCC TTATA
3501 CCGTG GAGAA CTAAA TGAAC ATTTG GGACT CCTGG GGCCA TATAT AAGAG
3551 CAGAA GTTGA AGATA ATATC ATGGT AACTT TCAGA AATCA GGCCT CTCGT
3601 CCCTA TTCCT TCTAT TCTAG CCTTA TTTCT TATGA GGAAG ATCAG AGGCA
3651 AGGAG CAGAA CCTAG AAAAA ACTTT GTCAA GCCTA ATGAA ACCAA AACTT
3701 ACTTT TGGAA AGTGC AACAT CATAT GGCAC CCACT AAAGA TGAGT TTGAC
3751 TGCAA AGCCT GGGCT TATTT CTCTG ATGTT GACCT GGAAA AAGAT GTGCA
3801 CTCAG GCCTG ATTGG ACCCC TTCTG GTCTG CCACA CTAAC ACACT GAACC
3851 CTGCT CATGG GAGAC AAGTG ACAGT ACAGG AATTT GCTCT GTTTT TCACC
3901 ATCTT TGATG AGACC AAAAG CTGGT ACTTC ACTGA AAATA TGGAA AGAAA
3951 CTGCA GGGCT CCCTG CAATA TCCAG ATGGA AGATC CCACT TTTAA AGAGA
4001 ATTAT CGCTT CCATG CAATC AATGG CTACA TAATG ATACA CTACA CTGGC
4051 TTAGT AATGG CTCAG GATCA AAGGA TTCGA TGGTA TCTGC TCAGC ATGGG
4101 CAGCA ATGAA AACAT CCATT CTATT CATTT CAGTG ACATG TGTT CACTG
4151 TACGA AAAAA AGAGG AGTAT AAAAT GGCAC TGTAC AATCT CTATC CAGGT
4201 GTTTT TGAGA CAGTG GAAAT GTTAC CATCC AAAGC TGGAA TTTGG CGGGT
4251 GGAAT GCCTT ATTGG CGAGC ATCTA CATGC TGGGA TGAGC ACACT TTTTC
4301 TGGTG TACAG CAATA AGTGT CAGAC TCCCC TGGGA ATGGC TTCTG GACAC
4351 ATTAG AGATT TTCAG ATTAC AGCTT CAGGA CAATA TGGAC AGTGG GCCCC
4401 AAAGC TGGCC AGACT TCATT ATTCC GGATC AATCA ATGCC TGGAG CACCA
4451 AGGAG CCCTT TTCTT GGATC AAGGT GGATC TGTTG GCACC AATGA TTATT
4501 CACGG CATCA AGACC CAGGG TGCCC GTCAG AAGTT CTCCA GCCTC TACAT
4551 CTCTC AGTTT ATCAT CATGT ATAGT CTTGA TGGGA AGAAG TGGCA GACTT
4601 ATCGA GGAAA TTCCA CTGGA ACCTT AATGG TCTTC TTTGG CAATG TGGAT
4651 TCATC TGGGA TAAAA CACAA TATTT TTAAC CCTCC AATTA TTGCT CGATA
4701 CATCC GTTTG CACCC AACTC ATTAT AGCAT CGCA GCACT CTTCG CATGG
4751 AGTTG ATGGG CTGTG ATTTA AATAG TTGCA GCATG CCATT GGGAA TGGAG
4801 AGTAA AGCAA TATCA GATGC ACAGA TTACT GCTTC ATCCT ACTTT ACCAA
4851 TATGT TTGCC ACCTG GTCTC CTTCA AAAGC TCGAC TTCAC CTCCA AGGGA
4901 GGAGT AATGC TGGA GACCT CAGGT GAATA ATCCA AAAGA GTGGC TGCAA
```

```
4951 GTGGA CTTCC AGAAG ACAAT GAAAG TCACA GGAGT AACTA CTCAG GGAGT

5001 AAAAT CTCTG CTTAC CAGCA TGTAT GTGAA GGAGT CCTCA TCTCC AGCA

5051 GTCAA GATGG CCATC AGTGG ACTCT CTTTT TTCAG AATGG CAAAG TAAAG

5101 GTTTT TCAGG GAAAT CAAGA CTCCT TCACA CCTGT GGTGA ACTCT CTAGA

5151 CCCAC CGTTA CTGAC TCGCT ACCTT CGAAT TCACC CCCAG AGTTG GGTGC

5201 ACCAG ATTGC CCTGA GGATG GAGGT TCTGG GCTGC GAGGC ACAGG ACCTC

5251 TACGA CAAAA CTCAC ACATG CCCAC CGTGC CCAGC TCCAG AACTC CTGGG

5301 CGGAC CGTCA GTCTT CCTCT TCCCC CCAAA ACCCA AGGAC ACCCT CATGG

5351 CCTCC CGGAC CCCTG AGGTC ACATG CGTGG TGGTG GACGT GAGCC ACGAA

5401 GACCC TGAGG TCAAG TTCAA CTGGT ACGTG GACGG CGTGG AGGTG CATAA

5451 TGCCA AGACA AAGCC GCGGG AGGAG CAGTA CAACA GCACG TACCG TGTGG

5501 TCAGC GTCCT CACCG TCCTG GCCCA GGACT GGCTG AATGG CAAGG AGTAC

5551 AAGTG CAAGG TCTCC AACAA AGCCC TCCCA GCCCC CATCG AGAAA ACCAT

5601 CTCCA AAGCC AAAGG GCAGC CCCGA GAACC ACAGG TGTAC ACCCT GCCCC

5651 CATCC CGGGA TGAGC TGACC AAGAA CCAGG TCAGC CTGAC CTGCC TGGTC

5701 AAAGG CTTCT ATCCC AGCGA CATCG CCGTG GAGTG GGAGA GCAAT GGGCA

5751 GCCGG AGAAC AACTA CAAGA CCACG CCTCC CGTGT GGACT CCGA CGGCT

5801 CCTTC TTCCT CTACA GCAAG CTCAC CGTGG ACAAG AGCAG GTGGC AGCAG

5851 GGGAA CGTCT TCTCA TGCTC CGTGA TGCAT GAGGC TCTGC ACAAC GCCTA

5901 CACGC AGAAG AGCCT CTCCC TGTCT CCGGG TAAAT GA
```

FVIII 283 Protein Sequence (FVIII 169 with IHH Triple Mutation) (SEQ ID NO: 161)

```
  1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNGAPGTS ESATPESGPG SEPATSGSET PGTSESATPE

801 SGPGSEPATS GSETPGTSES ATPESGPGTS TEPSEGSAPG SPAGSPTSTE

851 EGTSESATPE SGPGSEPATS GSETPGTSES ATPESGPGSP AGSPTSTEEG
```

```
 901  SPAGSPTSTE EGTSTEPSEG SAPGTSESAT PESGPGTSES ATPESGPGTS

951  ESATPESGPG SEPATSGSET PGSEPATSGS ETPGSPAGSP TSTEEGTSTE

1001  PSEGSAPGTS TEPSEGSAPG SEPATSGSET PGTSESATPE SGPGTSTEPS

1051  EGSAPASSPP VLKRHQAEIT RTTLQSDQEE IDYDDTISVE MKKEDFDIYD

1101  EDENQSPRSF QKKTRHYFIA AVERLWDYGM SSSPHVLRNR AQSGSVPQFK

1151  KVVFQEFTDG SFTQPLYRGE LNEHLGLLGP YIRAEVEDNI MVTFRNQASR

1201  PYSFYSSLIS YEEDQRQGAE PRKNFVKPNE TKTYFWKVQH HMAPTKDEFD

1251  CKAWAYFSDV DLEKDVHSGL IGPLLVCHTN TLNPAHGRQV TVQEFALFFT

1301  IFDETKSWYF TENMERNCRA PCNIQMEDPT FKENYRFHAI NGYIMDTLPG

1351  LVMAQDQRIR WYLLSMGSNE NIHSIHFSGH VFTVRKKEEY KMALYNLYPG

1401  VFETVEMLPS KAGIWRVECL IGEHLHAGMS TLFLVYSNKC QTPLGMASGH

1451  IRDFQITASG QYGQWAPKLA RLHYSGSINA WSTKEPFSWI KVDLLAPMII

1501  HGIKTQGARQ KFSSLYISQF IIMYSLDGKK WQTYRGNSTG TLMVFFGNVD

1551  SSGIKHNIFN PPIIARYIRL HPTHYSIRST LRMELMGCDL NSCSMPLGME

1601  SKAISDAQIT ASSYFTNMFA TWSPSKARLH LQGRSNAWRP QVNNPKEWLQ

1651  VDFQKTMKVT GVTTQGVKSL LTSMYVKEFL ISSSQDGHQW TLFFQNGKVK

1701  VFQGNQDSFT PVVNSLDPPL LTRYLRIHPQ SWVHQIALRM EVLGCEAQDL

1751  YDKTHTCPPC PAPELLGGPS VFLFPPKPKD TLMASRTPEV TCVVVDVSHE

1801  DPEVKFNWYV DGVEVHNAKT KPREEQYNST YRVVSVLTVL AQDWLNGKEY

1851  KCKVSNKALP APIEKTISKA KGQPREPQVY TLPPSRDELT KNQVSLTCLV

1901  KGFYPSDIAV EWESNGQPEN NYKTTPPVLD SDGSFFLYSK LTVDKSRWQQ

1951  GNVFSCSVMH EALHNAYTQK SLSLSPGK*
``` pSYNFVIII 010 Nucleotide Sequence-(Dual Chain FVIIIFc) (SEQ ID NO: 162)

```
  1  ATGCAAATAG AGCTCTCCAC CTGCTTCTTT CTGTGCCTTT TGCGATTCTG

51  CTTTAGTGCC ACCAGAAGAT ACTACCTGGG TGCAGTGGAA CTGTCATGGG

101  ACTATATGCA AAGTGATCTC GGTGAGCTGC CTGTGGACGC AAGATTTCCT

151  CCTAGAGTGC AAAATCTTT TCCATTCAAC ACCTCAGTCG TGTACAAAAA

201  GACTCTGTTT GTAGAATTCA CGGATCACCT TTTCAACATC GCTAAGCCAA

251  GGCCACCCTG GATGGGTCTG CTAGGTCCTA CCATCCAGGC TGAGGTTTAT

301  GATACAGTGG TCATTACACT TAAGAACATG GCTTCCCATC CTGTCAGTCT

351  TCATGCTGTT GGTGTATCCT ACTGGAAAGC TTCTGAGGGA GCTGAATATG

401  ATGATCAGAC CAGTCAAAGG GAGAAAGAAG ATGATAAAGT CTTCCCTGGT

451  GGAAGCCATA CATATGTCTG GCAGGTCCTG AAAGAGAATG GTCCAATGGC

501  CTCTGACCCA CTGTGCCTTA CCTACTCATA TCTTTCTCAT GTGGACCTGG

551  TAAAAGACTT GAATTCAGGC CTCATTGGAG CCCTACTAGT ATGTAGAGAA

601  GGGAGTCTGG CCAAGGAAAA GACACAGACC TTGCACAAAT TTATACTACT

651  TTTTGCTGTA TTTGATGAAG GGAAAAGTTG GCACTCAGAA ACAAAGAACT

701  CCTTGATGCA GGATAGGGAT GCTGCATCTG CTCGGGCCTG GCCTAAAATG
```

```
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTCAAAC
 951 ACTCTTGATG GACCTTGGAC AGTTTCTACT GTTTTGTCAT ATCTCTTCCC
1001 ACCAACATGA TGGCATGGAA GCTTATGTCA AAGTAGACAG CTGTCCAGAG
1051 GAACCCCAAC TACGAATGAA AATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AAGTCAATAT TTGAACAATG
1301 GCCCTCAGCG GATTGGTAGG AAGTACAAAA AAGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA AGAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCG
2101 ATGGAAAACC CAGGTCTATG GATTCTGGGG TGCCACAACT CAGACTTTCG
2151 GAACAGAGGC ATGACCGCCT TACTGAAGGT TTCTAGTTGT GACAAGAACA
2201 CTGGTGATTA TTACGAGGAC AGTTATGAAG ATATTTCAGC ATACTTGCTG
2251 AGTAAAAACA ATGCCATTGA ACCAAGAAGC TTCTCTCAAA ACCCACCAGT
2301 CTTGAAACGC CATCAACGGG AAATAACTCG TACTACTCTT CAGTCAGATC
2351 AAGAGGAAAT TGACTATGAT GATACCATAT CAGTTGAAAT GAAGAAGGAA
2401 GATTTTGACA TTTATGATGA GGATGAAAAT CAGAGCCCCC GCAGCTTTCA
2451 AAAGAAAACA CGACACTATT TTATTGCTGC AGTGGAGAGG CTCTGGGATT
2501 ATGGGATGAG TAGCTCCCCA CATGTTCTAA GAAACAGGGC TCAGAGTGGC
2551 AGTGTCCCTC AGTTCAAGAA AGTTGTTTTC CAGGAATTTA CTGATGGCTC
2601 CTTTACTCAG CCCTTATACC GTGGAGAACT AAATGAACAT TTGGGACTCC
2651 TGGGGCCATA TATAAGAGCA GAAGTTGAAG ATAATATCAT GGTAACTTTC
2701 AGAAATCAGG CCTCTCGTCC CTATTCCTTC TATTCTAGCC TTATTTCTTA
2751 TGAGGAAGAT CAGAGGCAAG GAGCAGAACC TAGAAAAAAC TTTGTCAAGC
```

```
2801 CTAATGAAAC CAAAACTTAC TTTTGGAAAG TGCAACATCA TATGGCACCC
2851 ACTAAAGATG AGTTTGACTG CAAAGCCTGG GCTTATTTCT CTGATGTTGA
2901 CCTGGAAAAA GATGTGCACT CAGGCCTGAT TGGACCCCTT CTGGTCTGCC
2951 ACACTAACAC ACTGAACCCT GCTCATGGGA GACAAGTGAC AGTACAGGAA
3001 TTTGCTCTGT TTTTCACCAT CTTTGATGAG ACCAAAAGCT GGTACTTCAC
3051 TGAAAATATG GAAAGAAACT GCAGGGCTCC CTGCAATATC CAGATGGAAG
3101 ATCCCACTTT TAAAGAGAAT TATCGCTTCC ATGCAATCAA TGGCTACATA
3151 ATGGATACAC TACCTGGCTT AGTAATGGCT CAGGATCAAA GGATTCGATG
3201 GTATCTGCTC AGCATGGGCA GCAATGAAAA CATCCATTCT ATTCATTTCA
3251 GTGGACATGT GTTCACTGTA CGAAAAAAAG AGGAGTATAA AATGGCACTG
3301 TACAATCTCT ATCCAGGTGT TTTTGAGACA GTGGAAATGT TACCATCCAA
3351 AGCTGGAATT TGGCGGGTGG AATGCCTTAT TGGCGAGCAT CTACATGCTG
3401 GGATGAGCAC ACTTTTTCTG GTGTACAGCA ATAAGTGTCA GACTCCCCTG
3451 GGAATGGCTT CTGGACACAT TAGAGATTTT CAGATTACAG CTTCAGGACA
3501 ATATGGACAG TGGGCCCCAA AGCTGGCCAG ACTTCATTAT TCCGGATCAA
3551 TCAATGCCTG GAGCACCAAG GAGCCCTTTT CTTGGATCAA GGTGGATCTG
3601 TTGGCACCAA TGATTATTCA CGGCATCAAG ACCCAGGGTG CCCGTCAGAA
3651 GTTCTCCAGC CTCTACATCT CTCAGTTTAT CATCATGTAT AGTCTTGATG
3701 GGAAGAAGTG GCAGACTTAT CGAGGAAATT CCACTGGAAC CTTAATGGTC
3751 TTCTTTGGCA ATGTGGATTC ATCTGGGATA AAACACAATA TTTTTAACCC
3801 TCCAATTATT GCTCGATACA TCCGTTTGCA CCCAACTCAT TATAGCATTC
3851 GCAGCACTCT TCGCATGGAG TTGATGGGCT GTGATTTAAA TAGTTGCAGC
3901 ATGCCATTGG GAATGGAGAG TAAAGCAATA TCAGATGCAC AGATTACTGC
3951 TTCATCCTAC TTTACCAATA TGTTTGCCAC CTGGTCTCCT TCAAAAGCTC
4001 GACTTCACCT CCAAGGGAGG AGTAATGCCT GGAGACCTCA GGTGAATAAT
4051 CCAAAAGAGT GGCTGCAAGT GGACTTCCAG AAGACAATGA AAGTCACAGG
4101 AGTAACTACT CAGGGAGTAA AATCTCTGCT TACCAGCATG TATGTGAAGG
4151 AGTTCCTCAT CTCCAGCAGT CAAGATGGCC ATCAGTGGAC TCTCTTTTTT
4201 CAGAATGGCA AAGTAAAGGT TTTTCAGGGA AATCAAGACT CCTTCACACC
4251 TGTGGTGAAC TCTCTAGACC CACCGTTACT GACTCGCTAC CTTCGAATTC
4301 ACCCCCAGAG TTGGGTGCAC CAGATTGCCC TGAGGATGGA GGTTCTGGGC
4351 TGCGAGGCAC AGGACCTCTA CGACAAAACT CACACATGCC CACCGTGCCC
4401 AGCTCCAGAA CTCCTGGGCG GACCGTCAGT CTTCCTCTTC CCCCCAAAAC
4451 CCAAGGACAC CCTCATGATC TCCCGGACCC CTGAGGTCAC ATGCGTGGTG
4501 GTGGACGTGA GCCACGAAGA CCCTGAGGTC AAGTTCAACT GGTACGTGGA
4551 CGGCGTGGAG GTGCATAATG CCAAGACAAA GCCGCGGGAG GAGCAGTACA
4601 ACAGCACGTA CCGTGTGGTC AGCGTCCTCA CCGTCCTGCA CCAGGACTGG
4651 CTGAATGGCA AGGAGTACAA GTGCAAGGTC TCCAACAAAG CCCTCCCAGC
4701 CCCCATCGAG AAAACCATCT CCAAAGCCAA AGGGCAGCCC CGAGAACCAC
4751 AGGTGTACAC CCTGCCCCCA TCCCGGGATG AGCTGACCAA GAACCAGGTC
```

```
4801 AGCCTGACCT GCCTGGTCAA AGGCTTCTAT CCCAGCGACA TCGCCGTGGA

4851 GTGGGAGAGC AATGGGCAGC CGGAGAACAA CTACAAGACC ACGCCTCCCG

4901 TGTTGGACTC CGACGGCTCC TTCTTCCTCT ACAGCAAGCT CACCGTGGAC

4951 AAGAGCAGGT GGCAGCAGGG GAACGTCTTC TCATGCTCCG TGATGCATGA

5001 GGCTCTGCAC AACCACTACA CGCAGAAGAG CCTCTCCCTG TCTCCGGGTA

5051 AATGA
``` pSYNFVIII 010 Protein Sequence-(Dual Chain FVIIIFc)
(SEQ ID NO: 163)

```
   1 MQIELSTCFF LCLLRFCFSA TRRYYLGAVE LSWDYMQSDL GELPVDARFP
  51 PRVPKSFPFN TSVVYKKTLF VEFTDHLFNI AKPRPPWMGL LGPTIQAEVY
 101 DTVVITLKNM ASHPVSLHAV GVSYWKASEG AEYDDQTSQR EKEDDKVFPG
 151 GSHTYVWQVL KENGPMASDP LCLTYSYLSH VDLVKDLNSG LIGALLVCRE
 201 GSLAKEKTQT LHKFILLFAV FDEGKSWHSE TKNSLMQDRD AASARAWPKM
 251 HTVNGYVNRS LPGLIGCHRK SVYWHVIGMG TTPEVHSIFL EGHTFLVRNH
 301 RQASLEISPI TFLTAQTLLM DLGQFLLFCH ISSHQHDGME AYVKVDSCPE
 351 EPQLRMKNNE EAEDYDDDLT DSEMDVVRFD DDNSPSFIQI RSVAKKHPKT
 401 WVHYIAAEEE DWDYAPLVLA PDDRSYKSQY LNNGPQRIGR KYKKVRFMAY
 451 TDETFKTREA IQHESGILGP LLYGEVGDTL LIIFKNQASR PYNIYPHGIT
 501 DVRPLYSRRL PKGVKHLKDF PILPGEIFKY KWTVTVEDGP TKSDPRCLTR
 551 YYSSFVNMER DLASGLIGPL LICYKESVDQ RGNQIMSDKR NVILFSVFDE
 601 NRSWYLTENI QRFLPNPAGV QLEDPEFQAS NIMHSINGYV FDSLQLSVCL
 651 HEVAYWYILS IGAQTDFLSV FFSGYTFKHK MVYEDTLTLF PFSGETVFMS
 701 MENPGLWILG CHNSDFRNRG MTALLKVSSC DKNTGDYYED SYEDISAYLL
 751 SKNNAIEPRS FSQNPPVLKR HQREITRTTL QSDQEEIDYD DTISVEMKKE
 801 DFDIYDEDEN QSPRSFQKKT RHYFIAAVER LWDYGMSSSP HVLRNRAQSG
 851 SVPQFKKVVF QEFTDGSFTQ PLYRGELNEH LGLLGPYIRA EVEDNIMVTF
 901 RNQASRPYSF YSSLISYEED QRQGAEPRKN FVKPNETKTY FWKVQHHMAP
 951 TKDEFDCKAW AYFSDVDLEK DVHSGLIGPL LVCHTNTLNP AHGRQVTVQE
1001 FALFFTIFDE TKSWYFTENM ERNCRAPCNI QMEDPTFKEN YRFHAINGYI
1051 MDTLPGLVMA QDQRIRWYLL SMGSNENIHS IHFSGHVFTV RKKEEYKMAL
1101 YNLYPGVFET VEMLPSKAGI WRVECLIGEH LHAGMSTLFL VYSNKCQTPL
1151 GMASGHIRDF QITASGQYGQ WAPKLARLHY SGSINAWSTK EPFSWIKVDL
1201 LAPMIIHGIK TQGARQKFSS LYISQFIIMY SLDGKKWQTY RGNSTGTLMV
1251 FFGNVDSSGI KHNIFNPPII ARYIRLHPTH YSIRSTLRME LMGCDLNSCS
1301 MPLGMESKAI SDAQITASSY FTNMFATWSP SKARLHLQGR SNAWRPQVNN
1351 PKEWLQVDFQ KTMKVTGVTT QGVKSLLTSM YVKEFLISSS QDGHQWTLFF
1401 QNGKVKVFQG NQDSFTPVVN SLDPPLLTRY LRIHPQSWVH QIALRMEVLG
1451 CEAQDLYDKT HTCPPCPAPE LLGGPSVFLF PPKPKDTLMI SRTPEVTCVV
1501 VDVSHEDPEV KFNWYVDGVE VHNAKTKPRE EQYNSTYRVV SVLTVLHQDW
1551 LNGKEYKCKV SNKALPAPIE KTISKAKGQP REPQVYTLPP SRDELTKNQV
```

-continued

```
1601 SLTCLVKGFY PSDIAVEWES NGQPENNYKT TPPVLDSDGS FFLYSKLTVD

1651 KSRWQQGNVF SCSVMHEALH NHYTQKSLSL SPGK*
```

FVIII 195 Protein Sequence (Dual Chain FVIIIFc with Two 144 AE XTENs at Amino Acid 1656 and 1900) (SEQ ID NO: 73)

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNPPVLKR HQREITRTTL QGAPGTPGSG TASSSPGASP

801 GTSSTGSPGA SPGTSSTGSP GASPGTSSTG SPGSSPSAST GTGPGTPGSG

851 TASSSPGASP GTSSTGSPGA SPGTSSTGSP GASPGTSSTG SPGSSTPSGA

901 TGSPGSSTPS GATGSPGASP GTSSTGSPAS SSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE

1151 FALFFTIFDE TKSWYFTENM ERNCRGAPTS ESATPESGPG SEPATSGSET

1201 PGTSESATPE SGPGSEPATS GSETPGTSES ATPESGPGTS TEPSEGSAPG

1251 TSESATPESG PGSPAGSPTS TEEGSPAGSP TSTEEGSPAG SPTSTEEGTS

1301 ESATPESGPG TSTEPSEGSA PGASSAPCNI QMEDPTFKEN YRFHAINGYI

1351 MDTLPGLVMA QDQRIRWYLL SMGSNENIHS IHFSGHVFTV RKKEEYKMAL

1401 YNLYPGVFET VEMLPSKAGI WRVECLIGEH LHAGMSTLFL VYSNKCQTPL

1451 GMASGHIRDF QITASGQYGQ WAPKLARLHY SGSINAWSTK EPFSWIKVDL

1501 LAPMIIHGIK TQGARQKFSS LYISQFIIMY SLDGKKWQTY RGNSTGTLMV

1551 FFGNVDSSGI KHNIFNPPII ARYIRLHPTH YSIRSTLRME LMGCDLNSCS

1601 MPLGMESKAI SDAQITASSY FTNMFATWSP SKARLHLQGR SNAWRPQVNN

1651 PKEWLQVDFQ KTMKVTGVTT QGVKSLLTSM YVKEFLISSS QDGHQWTLFF

1701 QNGKVKVFQG NQDSFTPVVN SLDPPLLTRY LRIHPQSWVH QIALRMEVLG
```

```
1751 CEAQDLYDKT HTCPPCPAPE LLGGPSVFLF PPKPKDTLMI SRTPEVTCVV

1801 VDVSHEDPEV KFNWYVDGVE VHNAKTKPRE EQYNSTYRVV SVLTVLHQDW

1851 LNGKEYKCKV SNKALPAPIE KTISKAKGQP REPQVYTLPP SRDELTKNQV

1901 SLTCLVKGFY PSDIAVEWES NGQPENNYKT TPPVLDSDGS FFLYSKLTVD

1951 KSRWQQGNVF SCSVMHEALH NHYTQKSLSL SPGK*
``` pSYN-FVIII-173 Mature Protein Sequencing (SEQ ID NO: 72):

```
   1 ATRRYYLGAV ELSWDYMQSD LGELPVDARF PPRVPKSFPF NTSVVYKKTL

51 FVEFTDHLFN IAKPRPPWMG LLGPTIQAEV YDTVVITLKN MASHPVSLHA

101 VGVSYWKASE GAEYDDQTSQ REKEDDKVFP GGSHTYVWQV LKENGPMASD

151 PLCLTYSYLS HVDLVKDLNS GLIGALLVCR EGSLAKEKTQ TLHKFILLFA

201 VFDEGKSWHS ETKNSLMQDR DAASARAWPK MHTVNGYVNR SLPGLIGCHR

251 KSVYWHVIGM GTTPEVHSIF LEGHTFLVRN HRQASLEISP ITFLTAQTLL

301 MDLGQFLLFC HISSHQHDGM EAYVKVDSCP EEPQLRMKNN EEAEDYDDDL

351 TDSEMDVVRF DDDNSPSFIQ IRSVAKKHPK TWVHYIAAEE EDWDYAPLVL

401 APDDRSYKSQ YLNNGPQRIG RKYKKVRFMA YTDETFKTRE AIQHESGILG

451 PLLYGEVGDT LLIIFKNQAS RPYNIYPHGI TDVRPLYSRR LPKGVKHLKD

501 FPILPGEIFK YKWTVTVEDG PTKSDPRCLT RYYSSFVNME RDLASGLIGP

551 LLICYKESVD QRGNQIMSDK RNVILFSVFD ENRSWYLTEN IQRFLPNPAG

601 VQLEDPEFQA SNIMHSINGY VFDSLQLSVC LHEVAYWYIL SIGAQTDFLS

651 VFFSGYTFKH KMVYEDTLTL FPFSGETVFM SMENPGLWIL GCHNSDFRNR

701 GMTALLKVSS CDKNTGDYYE DSYEDISAYL LSKNNAIEPR SFSQNGAPGT

751 SESATPESGP GSEPATSGSE TPGTSESATP ESGPGSEPAT SGSETPGTSE

801 SATPESGPGT STEPSEGSAP GSPAGSPTST EEGTSESATP ESGPGSEPAT

851 SGSETPGTSE SATPESGPGS PAGSPTSTEE GSPAGSPTST EEGTSTEPSE

901 GSAPGTSESA TPESGPGTSE SATPESGPGT SESATPESGP GSEPATSGSE

951 TPGSEPATSG SETPGSPAGS PTSTEEGTST EPSEGSAPGT STEPSEGSAP

1001 GSEPATSGSE TPGTSESATP ESGPGTSTEP SEGSAPASSP PVLKRHQREI

1051 TRTTLQSDQE EIDYDDTISV EMKKEDFDIY DEDENQSPRS FQKKTRHYFI

1101 AAVERLWDYG MSSSPHVLRN RAQSGSVPQF KKVVFQEFTD GSFTQPLYRG

1151 ELNEHLGLLG PYIRAEVEDN IMVTFRNQAS RPYSFYSSLI SYEEDQRQGA

1201 EPRKNFVKPN ETKTYFWKVQ HHMAPTKDEF DCKAWAYFSD VDLEKDVHSG

1251 LIGPLLVCHT NTLNPAHGRQ VTVQEFALFF TIFDETKSWY FTENMERNCR

1301 APCNIQMEDP TFKENYRFHA INGYIMDTLP GLVMAQDQRI RWYLLSMGSN

1351 ENIHSIHFSG HVFTVRKKEE YKMALYNLYP GVFETVEMLP SKAGIWRVEC

1401 LIGEHLHAGM STLFLVYSNK CQTPLGMASG HIRDFQITAS GQYGQWAPKL

1451 ARLHYSGSIN AWSTKEPFSW IKVDLLAPMI IHGIKTQGAR QKFSSLYISQ

1501 FIIMYSLDGK KWQTYRGNST GTLMVFFGNV DSSGIKHNIF NPPIIARYIR

1551 LHPTHYSIRS TLRMELMGCD LNSCSMPLGM ESKAISDAQI TASSYFTNMF
```

-continued

```
1601 ATWSPSKARL HLQGRSNAWR PQVNNPKEWL QVDFQKTMKV TGVTTQGVKS

1651 LLTSMYVKEF LISSSQDGHQ WTLFFQNGKV KVFQGNQDSF TPVVNSLDPP

1701 LLTRYLRIHP QSWVHQIALR MEVLGCEAQD LYDKTHTCPP CPAPELLGGP

1751 SVFLFPPKPK DTLMISRTPE VTCVVVDVSH EDPEVKFNWY VDGVEVHNAK

1801 TKPREEQYNS TYRVVSVLTV LHQDWLNGKE YKCKVSNKAL PAPIEKTISK

1851 AKGQPREPQV YTLPPSRDEL TKNQVSLTCL VKGFYPSDIA VEWESNGQPE

1901 NNYKTTPPVL DSDGSFFLYS KLTVDKSRWQ QGNVFSCSVM HEALHNHYTQ

1951 KSLSLSPGK
```

FVIII 196 Protein Sequence (Dual Chain FVIIIFc with Three 144 AE XTENs at Amino Acid 26, 1656 and 1900) (SEQ ID NO: 74)

```
   1 MQIELSTCFF LCLLRFCFSA TRRYYLGAVE LSWDYMQSDL GELPVGAPGS

51 SPSASTGTGP GSSPSASTGT GPGASPGTSS TGSPGASPGT SSTGSPGSST

101 PSGATGSPGS SPSASTGTGP GASPGTSSTG SPGSSPSAST GTGPGTPGSG

151 TASSSPGSST PSGATGSPGS STPSGATGSP GASPGTSSTG SPASSDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNPPVLKR HQREITRTTL QGAPGTPGSG TASSSPGASP

951 GTSSTGSPGA SPGTSSTGSP GASPGTSSTG SPGSSPSAST GTGPGTPGSG

1001 TASSSPGASP GTSSTGSPGA SPGTSSTGSP GASPGTSSTG SPGSSTPSGA

1051 TGSPGSSTPS GATGSPGASP GTSSTGSPAS SSDQEEIDYD DTISVEMKKE

1101 DFDIYDEDEN QSPRSFQKKT RHYFIAAVER LWDYGMSSSP HVLRNRAQSG

1151 SVPQFKKVVF QEFTDGSFTQ PLYRGELNEH LGLLGPYIRA EVEDNIMVTF

1201 RNQASRPYSF YSSLISYEED QRQGAEPRKN FVKPNETKTY FWKVQHHMAP

1251 TKDEFDCKAW AYFSDVDLEK DVHSGLIGPL LVCHTNTLNP AHGRQVTVQE

1301 FALFFTIFDE TKSWYFTENM ERNCRGAPTS ESATPESGPG SEPATSGSET

1351 PGTSESATPE SGPGSEPATS GSETPGTSES ATPESGPGTS TEPSEGSAPG

1401 TSESATPESG PGSPAGSPTS TEEGSPAGSP TSTEEGSPAG SPTSTEEGTS
```

-continued

```
1451 ESATPESGPG TSTEPSEGSA PGASSAPCNI QMEDPTFKEN YRFHAINGYI

1501 MDTLPGLVMA QDQRIRWYLL SMGSNENIHS IHFSGHVFTV RKKEEYKMAL

1551 YNLYPGVFET VEMLPSKAGI WRVECLIGEH LHAGMSTLFL VYSNKCQTPL

1601 GMASGHIRDF QITASGQYGQ WAPKLARLHY SGSINAWSTK EPFSWIKVDL

1651 LAPMIIHGIK TQGARQKFSS LYISQFIIMY SLDGKKWQTY RGNSTGTLMV

1701 FFGNVDSSGI KHNIFNPPII ARYIRLHPTH YSIRSTLRME LMGCDLNSCS

1751 MPLGMESKAI SDAQITASSY FTNMFATWSP SKARLHLQGR SNAWRPQVNN

1801 PKEWLQVDFQ KTMKVTGVTT QGVKSLLTSM YVKEFLISSS QDGHQWTLFF

1851 QNGKVKVFQG NQDSFTPVVN SLDPPLLTRY LRIHPQSWVH QIALRMEVLG

1901 CEAQDLYDKT HTCPPCPAPE LLGGPSVFLF PPKPKDTLMI SRTPEVTCVV

1951 VDVSHEDPEV KFNWYVDGVE VHNAKTKPRE EQYNSTYRVV SVLTVLHQDW

2001 LNGKEYKCKV SNKALPAPIE KTISKAKGQP REPQVYTLPP SRDELTKNQV

2051 SLTCLVKGFY PSDIAVEWES NGQPENNYKT TPPVLDSDGS FFLYSKLTVD

2101 KSRWQQGNVF SCSVMHEALH NHYTQKSLSL SPGK*
```

FVIII 199 Protein Sequence (Single Chain FVIIIFc with Three 144 AE XTENs at amino acid 1656 and 1900) (SEQ ID NO: 75)

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNPPVLKR HQAEITRTTL QGAPGTPGSG TASSSPGASP

801 GTSSTGSPGA SPGTSSTGSP GASPGTSSTG SPGSSPSAST GTGPGTPGSG

851 TASSSPGASP GTSSTGSPGA SPGTSSTGSP GASPGTSSTG SPGSSTPSGA

901 TGSPGSSTPS GATGSPGASP GTSSTGSPAS SSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE
```

```
1151  FALFFTIFDE  TKSWYFTENM  ERNCRGAPTS  ESATPESGPG  SEPATSGSET

1201  PGTSESATPE  SGPGSEPATS  GSETPGTSES  ATPESGPGTS  TEPSEGSAPG

1251  TSESATPESG  PGSPAGSPTS  TEEGSPAGSP  TSTEEGSPAG  SPTSTEEGTS

1301  ESATPESGPG  TSTEPSEGSA  PGASSAPCNI  QMEDPTFKEN  YRFHAINGYI

1351  MDTLPGLVMA  QDQRIRWYLL  SMGSNENIHS  IHFSGHVFTV  RKKEEYKMAL

1401  YNLYPGVFET  VEMLPSKAGI  WRVECLIGEH  LHAGMSTLFL  VYSNKCQTPL

1451  GMASGHIRDF  QITASGQYGQ  WAPKLARLHY  SGSINAWSTK  EPFSWIKVDL

1501  LAPMIIHGIK  TQGARQKFSS  LYISQFIIMY  SLDGKKWQTY  RGNSTGTLMV

1551  FFGNVDSSGI  KHNIFNPPII  ARYIRLHPTH  YSIRSTLRME  LMGCDLNSCS

1601  MPLGMESKAI  SDAQITASSY  FTNMFATWSP  SKARLHLQGR  SNAWRPQVNN

1651  PKEWLQVDFQ  KTMKVTGVTT  QGVKSLLTSM  YVKEFLISSS  QDGHQWTLFF

1701  QNGKVKVFQG  NQDSFTPVVN  SLDPPLLTRY  LRIHPQSWVH  QIALRMEVLG

1751  CEAQDLYDKT  HTCPPCPAPE  LLGGPSVFLF  PPKPKDTLMI  SRTPEVTCVV

1801  VDVSHEDPEV  KFNWYVDGVE  VHNAKTKPRE  EQYNSTYRVV  SVLTVLHQDW

1851  LNGKEYKCKV  SNKALPAPIE  KTISKAKGQP  REPQVYTLPP  SRDELTKNQV

1901  SLTCLVKGFY  PSDIAVEWES  NGQPENNYKT  TPPVLDSDGS  FFLYSKLTVD

1951  KSRWQQGNVF  SCSVMHEALH  NHYTQKSLSL  SPGK*
```

FVIII 201 Protein Sequence (Single Chain FVIIIFc with Three 144 AE XTENs at amino acid 26, 1656 &1900) (SEQ ID NO: 76)

```
   1  MQIELSTCFF  LCLLRFCFSA  TRRYYLGAVE  LSWDYMQSDL  GELPVGAPGS

51  SPSASTGTGP  GSSPSASTGT  GPGASPGTSS  TGSPGASPGT  SSTGSPGSST

101  PSGATGSPGS  SPSASTGTGP  GASPGTSSTG  SPGSSPSAST  GTGPGTPGSG

151  TASSSPGSST  PSGATGSPGS  STPSGATGSP  GASPGTSSTG  SPASSDARFP

201  PRVPKSFPFN  TSVVYKKTLF  VEFTDHLFNI  AKPRPPWMGL  LGPTIQAEVY

251  DTVVITLKNM  ASHPVSLHAV  GVSYWKASEG  AEYDDQTSQR  EKEDDKVFPG

301  GSHTYVWQVL  KENGPMASDP  LCLTYSYLSH  VDLVKDLNSG  LIGALLVCRE

351  GSLAKEKTQT  LHKFILLFAV  FDEGKSWHSE  TKNSLMQDRD  AASARAWPKM

401  HTVNGYVNRS  LPGLIGCHRK  SVYWHVIGMG  TTPEVHSIFL  EGHTFLVRNH

451  RQASLEISPI  TFLTAQTLLM  DLGQFLLFCH  ISSHQHDGME  AYVKVDSCPE

501  EPQLRMKNNE  EAEDYDDDLT  DSEMDVVRFD  DDNSPSFIQI  RSVAKKHPKT

551  WVHYIAAEEE  DWDYAPLVLA  PDDRSYKSQY  LNNGPQRIGR  KYKKVRFMAY

601  TDETFKTREA  IQHESGILGP  LLYGEVGDTL  LIIFKNQASR  PYNIYPHGIT

651  DVRPLYSRRL  PKGVKHLKDF  PILPGEIFKY  KWTVTVEDGP  TKSDPRCLTR

701  YYSSFVNMER  DLASGLIGPL  LICYKESVDQ  RGNQIMSDKR  NVILFSVFDE

751  NRSWYLTENI  QRFLPNPAGV  QLEDPEFQAS  NIMHSINGYV  FDSLQLSVCL

801  HEVAYWYILS  IGAQTDFLSV  FFSGYTFKHK  MVYEDTLTLF  PFSGETVFMS

851  MENPGLWILG  CHNSDFRNRG  MTALLKVSSC  DKNTGDYYED  SYEDISAYLL

901  SKNNAIEPRS  FSQNPPVLKR  HQAEITRTTL  QGAPGTPGSG  TASSSPGASP

951  GTSSTGSPGA  SPGTSSTGSP  GASPGTSSTG  SPGSSPSAST  GTGPGTPGSG
```

```
1001  TASSSPGASP  GTSSTGSPGA  SPGTSSTGSP  GASPGTSSTG  SPGSSTPSGA

1051  TGSPGSSTPS  GATGSPGASP  GTSSTGSPAS  SSDQEEIDYD  DTISVEMKKE

1101  DFDIYDEDEN  QSPRSFQKKT  RHYFIAAVER  LWDYGMSSSP  HVLRNRAQSG

1151  SVPQFKKVVF  QEFTDGSFTQ  PLYRGELNEH  LGLLGPYIRA  EVEDNIMVTF

1201  RNQASRPYSF  YSSLISYEED  QRQGAEPRKN  FVKPNETKTY  FWKVQHHMAP

1251  TKDEFDCKAW  AYFSDVDLEK  DVHSGLIGPL  LVCHTNTLNP  AHGRQVTVQE

1301  FALFFTIFDE  TKSWYFTENM  ERNCRGAPTS  ESATPESGPG  SEPATSGSET

1351  PGTSESATPE  SGPGSEPATS  GSETPGTSES  ATPESGPGTS  TEPSEGSAPG

1401  TSESATPESG  PGSPAGSPTS  TEEGSPAGSP  TSTEEGSPAG  SPTSTEEGTS

1451  ESATPESGPG  TSTEPSEGSA  PGASSAPCNI  QMEDPTFKEN  YRFHAINGYI

1501  MDTLPGLVMA  QDQRIRWYLL  SMGSNENIHS  IHFSGHVFTV  RKKEEYKMAL

1551  YNLYPGVFET  VEMLPSKAGI  WRVECLIGEH  LHAGMSTLFL  VYSNKCQTPL

1601  GMASGHIRDF  QITASGQYGQ  WAPKLARLHY  SGSINAWSTK  EPFSWIKVDL

1651  LAPMIIHGIK  TQGARQKFSS  LYISQFIIMY  SLDGKKWQTY  RGNSTGTLMV

1701  FFGNVDSSGI  KHNIFNPPII  ARYIRLHPTH  YSIRSTLRME  LMGCDLNSCS

1751  MPLGMESKAI  SDAQITASSY  FTNMFATWSP  SKARLHLQGR  SNAWRPQVNN

1801  PKEWLQVDFQ  KTMKVTGVTT  QGVKSLLTSM  YVKEFLISSS  QDGHQWTLFF

1851  QNGKVKVFQG  NQDSFTPVVN  SLDPPLLTRY  LRIHPQSWVH  QIALRMEVLG

1901  CEAQDLYDKT  HTCPPCPAPE  LLGGPSVFLF  PPKPKDTLMI  SRTPEVTCVV

1951  VDVSHEDPEV  KFNWYVDGVE  VHNAKTKPRE  EQYNSTYRVV  SVLTVLHQDW

2001  LNGKEYKCKV  SNKALPAPIE  KTISKAKGQP  REPQVYTLPP  SRDELTKNQV

2051  SLTCLVKGFY  PSDIAVEWES  NGQPENNYKT  TPPVLDSDGS  FFLYSKLTVD

2101  KSRWQQGNVF  SCSVMHEALH  NHYTQKSLSL  SPGK*
```

FVIII 203 Protein Sequence (Single Chain FVIIIFc with Two AE XTENs; One 288AE XTEN in B-Domain and One 144 AE XTEN at Amino Acid 1900) (SEQ ID NO: 77)

```
   1  MQIELSTCFF  LCLLRFCFSA  TRRYYLGAVE  LSWDYMQSDL  GELPVDARFP

51  PRVPKSFPFN  TSVVYKKTLF  VEFTDHLFNI  AKPRPPWMGL  LGPTIQAEVY

101  DTVVITLKNM  ASHPVSLHAV  GVSYWKASEG  AEYDDQTSQR  EKEDDKVFPG

151  GSHTYVWQVL  KENGPMASDP  LCLTYSYLSH  VDLVKDLNSG  LIGALLVCRE

201  GSLAKEKTQT  LHKFILLFAV  FDEGKSWHSE  TKNSLMQDRD  AASARAWPKM

251  HTVNGYVNRS  LPGLIGCHRK  SVYWHVIGMG  TTPEVHSIFL  EGHTFLVRNH

301  RQASLEISPI  TFLTAQTLLM  DLGQFLLFCH  ISSHQHDGME  AYVKVDSCPE

351  EPQLRMKNNE  EAEDYDDDLT  DSEMDVVRFD  DDNSPSFIQI  RSVAKKHPKT

401  WVHYIAAEEE  DWDYAPLVLA  PDDRSYKSQY  LNNGPQRIGR  KYKKVRFMAY

451  TDETFKTREA  IQHESGILGP  LLYGEVGDTL  LIIFKNQASR  PYNIYPHGIT

501  DVRPLYSRRL  PKGVKHLKDF  PILPGEIFKY  KWTVTVEDGP  TKSDPRCLTR

551  YYSSFVNMER  DLASGLIGPL  LICYKESVDQ  RGNQIMSDKR  NVILFSVFDE

601  NRSWYLTENI  QRFLPNPAGV  QLEDPEFQAS  NIMHSINGYV  FDSLQLSVCL

651  HEVAYWYILS  IGAQTDFLSV  FFSGYTFKHK  MVYEDTLTLF  PFSGETVFMS
```

-continued

```
 701 MENPGLWILG CHNSDFRNRG MTALLKVSSC DKNTGDYYED SYEDISAYLL

751 SKNNAIEPRS FSQNGAPGTS ESATPESGPG SEPATSGSET PGTSESATPE

801 SGPGSEPATS GSETPGTSES ATPESGPGTS TEPSEGSAPG SPAGSPTSTE

851 EGTSESATPE SGPGSEPATS GSETPGTSES ATPESGPGSP AGSPTSTEEG

901 SPAGSPTSTE EGTSTEPSEG SAPGTSESAT PESGPGTSES ATPESGPGTS

951 ESATPESGPG SEPATSGSET PGSEPATSGS ETPGSPAGSP TSTEEGTSTE

1001 PSEGSAPGTS TEPSEGSAPG SEPATSGSET PGTSESATPE SGPGTSTEPS

1051 EGSAPASSPP VLKRHQAEIT RTTLQSDQEE IDYDDTISVE MKKEDFDIYD

1101 EDENQSPRSF QKKTRHYFIA AVERLWDYGM SSSPHVLRNR AQSGSVPQFK

1151 KVVFQEFTDG SFTQPLYRGE LNEHLGLLGP YIRAEVEDNI MVTFRNQASR

1201 PYSFYSSLIS YEEDQRQGAE PRKNFVKPNE TKTYFWKVQH HMAPTKDEFD

1251 CKAWAYFSDV DLEKDVHSGL IGPLLVCHTN TLNPAHGRQV TVQEFALFFT

1301 IFDETKSWYF TENMERNCRG APTSESATPE SGPGSEPATS GSETPGTSES

1351 ATPESGPGSE PATSGSETPG TSESATPESG PGTSTEPSEG SAPGTSESAT

1401 PESGPGSPAG SPTSTEEGSP AGSPTSTEEG SPAGSPTSTE EGTSESATPE

1451 SGPGTSTEPS EGSAPGASSA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMISRTPEV TCVVVDVSHE

1951 DPEVKFNWYV DGVEVHNAKT KPREEQYNST YRVVSVLTVL HQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNHYTQK SLSLSPGK*
```

FVIII 204 Protein Sequence (Single Chain FVIIIFc with Two AE XTENs; One 288AE XTEN in B-Domain and One 144 AE XTEN at Amino Acid 403) (SEQ ID NO: 78)

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT
```

-continued

```
 401  WVHYIAAEEE DWDYAPLVLA PDGAPTSTEP SEGSAPGSPA GSPTSTEEGT

451  STEPSEGSAP GTSTEPSEGS APGTSESATP ESGPGTSTEP SEGSAPGTSE

501  SATPESGPGS EPATSGSETP GTSTEPSEGS APGTSTEPSE GSAPGTSESA

551  TPESGPGTSE SATPESGPGA SSDRSYKSQY LNNGPQRIGR KYKKVRFMAY

601  TDETFKTREA IQHESGILGP LLYGEVGDTL LIIFKNQASR PYNIYPHGIT

651  DVRPLYSRRL PKGVKHLKDF PILPGEIFKY KWTVTVEDGP TKSDPRCLTR

701  YYSSFVNMER DLASGLIGPL LICYKESVDQ RGNQIMSDKR NVILFSVFDE

751  NRSWYLTENI QRFLPNPAGV QLEDPEFQAS NIMHSINGYV FDSLQLSVCL

801  HEVAYWYILS IGAQTDFLSV FFSGYTFKHK MVYEDTLTLF PFSGETVFMS

851  MENPGLWILG CHNSDFRNRG MTALLKVSSC DKNTGDYYED SYEDISAYLL

901  SKNNAIEPRS FSQNGAPGTS ESATPESGPG SEPATSGSET PGTSESATPE

951  SGPGSEPATS GSETPGTSES ATPESGPGTS TEPSEGSAPG SPAGSPTSTE

1001  EGTSESATPE SGPGSEPATS GSETPGTSES ATPESGPGSP AGSPTSTEEG

1051  SPAGSPTSTE EGTSTEPSEG SAPGTSESAT PESGPGTSES ATPESGPGTS

1101  ESATPESGPG SEPATSGSET PGSEPATSGS ETPGSPAGSP TSTEEGTSTE

1151  PSEGSAPGTS TEPSEGSAPG SEPATSGSET PGTSESATPE SGPGTSTEPS

1201  EGSAPASSPP VLKRHQAEIT RTTLQSDQEE IDYDDTISVE MKKEDFDIYD

1251  EDENQSPRSF QKKTRHYFIA AVERLWDYGM SSSPHVLRNR AQSGSVPQFK

1301  KVVFQEFTDG SFTQPLYRGE LNEHLGLLGP YIRAEVEDNI MVTFRNQASR

1351  PYSFYSSLIS YEEDQRQGAE PRKNFVKPNE TKTYFWKVQH HMAPTKDEFD

1401  CKAWAYFSDV DLEKDVHSGL IGPLLVCHTN TLNPAHGRQV TVQEFALFFT

1451  IFDETKSWYF TENMERNCRA PCNIQMEDPT FKENYRFHAI NGYIMDTLPG

1501  LVMAQDQRIR WYLLSMGSNE NIHSIHFSGH VFTVRKKEEY KMALYNLYPG

1551  VFETVEMLPS KAGIWRVECL IGEHLHAGMS TLFLVYSNKC QTPLGMASGH

1601  IRDFQITASG QYGQWAPKLA RLHYSGSINA WSTKEPFSWI KVDLLAPMII

1651  HGIKTQGARQ KFSSLYISQF IIMYSLDGKK WQTYRGNSTG TLMVFFGNVD

1701  SSGIKHNIFN PPIIARYIRL HPTHYSIRST LRMELMGCDL NSCSMPLGME

1751  SKAISDAQIT ASSYFTNMFA TWSPSKARLH LQGRSNAWRP QVNNPKEWLQ

1801  VDFQKTMKVT GVTTQGVKSL LTSMYVKEFL ISSSQDGHQW TLFFQNGKVK

1851  VFQGNQDSFT PVVNSLDPPL LTRYLRIHPQ SWVHQIALRM EVLGCEAQDL

1901  YDKTHTCPPC PAPELLGGPS VFLFPPKPKD TLMISRTPEV TCVVVDVSHE

1951  DPEVKFNWYV DGVEVHNAKT KPREEQYNST YRVVSVLTVL HQDWLNGKEY

2001  KCKVSNKALP APIEKTISKA KGQPREPQVY TLPPSRDELT KNQVSLTCLV

2051  KGFYPSDIAV EWESNGQPEN NYKTTPPVLD SDGSFFLYSK LTVDKSRWQQ

2101  GNVFSCSVMH EALHNHYTQK SLSLSPGK*
```

FVIII 205 Protein Sequence (Single Chain FVIIIFc with Two AE XTENs; One 288AE XTEN in B-Domain and One 144 AE XTEN at Amino Acid 18) (SEQ ID NO: 79)

```
   1  MQIELSTCFF LCLLRFCFSA TRRYYLGAVE LSWDYMQGAP TSESATPESG

51  PGSEPATSGS ETPGTSESAT PESGPGSEPA TSGSETPGTS ESATPESGPG
```

```
 101 TSTEPSEGSA PGSPAGSPTS TEEGTSESAT PESGPGSEPA TSGSETPGTS

151 ESATPESGPG SPAGSPTSTE EGSPAGSPTS TEEGASSSDL GELPVDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNGAPGTS ESATPESGPG SEPATSGSET PGTSESATPE

951 SGPGSEPATS GSETPGTSES ATPESGPGTS TEPSEGSAPG SPAGSPTSTE

1001 EGTSESATPE SGPGSEPATS GSETPGTSES ATPESGPGSP AGSPTSTEEG

1051 SPAGSPTSTE EGTSTEPSEG SAPGTSESAT PESGPGTSES ATPESGPGTS

1101 ESATPESGPG SEPATSGSET PGSEPATSGS ETPGSPAGSP TSTEEGTSTE

1151 PSEGSAPGTS TEPSEGSAPG SEPATSGSET PGTSESATPE SGPGTSTEPS

1201 EGSAPASSPP VLKRHQAEIT RTTLQSDQEE IDYDDTISVE MKKEDFDIYD

1251 EDENQSPRSF QKKTRHYFIA AVERLWDYGM SSSPHVLRNR AQSGSVPQFK

1301 KVVFQEFTDG SFTQPLYRGE LNEHLGLLGP YIRAEVEDNI MVTFRNQASR

1351 PYSFYSSLIS YEEDQRQGAE PRKNFVKPNE TKTYFWKVQH HMAPTKDEFD

1401 CKAWAYFSDV DLEKDVHSGL IGPLLVCHTN TLNPAHGRQV TVQEFALFFT

1451 IFDETKSWYF TENMERNCRA PCNIQMEDPT FKENYRFHAI NGYIMDTLPG

1501 LVMAQDQRIR WYLLSMGSNE NIHSIHFSGH VFTVRKKEEY KMALYNLYPG

1551 VFETVEMLPS KAGIWRVECL IGEHLHAGMS TLFLVYSNKC QTPLGMASGH

1601 IRDFQITASG QYGQWAPKLA RLHYSGSINA WSTKEPFSWI KVDLLAPMII

1651 HGIKTQGARQ KFSSLYISQF IIMYSLDGKK WQTYRGNSTG TLMVFFGNVD

1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 YDKTHTCPPC PAPELLGGPS VFLFPPKPKD TLMISRTPEV TCVVVDVSHE

1951 DPEVKFNWYV DGVEVHNAKT KPREEQYNST YRVVSVLTVL HQDWLNGKEY

2001 KCKVSNKALP APIEKTISKA KGQPREPQVY TLPPSRDELT KNQVSLTCLV

2051 KGFYPSDIAV EWESNGQPEN NYKTTPPVLD SDGSFFLYSK LTVDKSRWQQ

2101 GNVFSCSVMH EALHNHYTQK SLSLSPGK*
``` pSYN FVIII 266 Protein Sequence (FVIII Fc with 42 AE-XTEN at Amino Acid 18 and 288 AE XTEN in B-Domain) SEQ ID NO: 80)

```
   1 MQIELSTCFF LCLLRFCFSA TRRYYLGAVE LSWDYMQGAP GSPAGSPTST
  51 EEGTSESATP ESGPGSEPAT SGSETPASSS DLGELPVDAR FPPRVPKSFP
 101 FNTSVVYKKT LFVEFTDHLF NIAKPRPPWM GLLGPTIQAE VYDTVVITLK
 151 NMASHPVSLH AVGVSYWKAS EGAEYDDQTS QREKEDDKVF PGGSHTYVWQ
 201 VLKENGPMAS DPLCLTYSYL SHVDLVKDLN SGLIGALLVC REGSLAKEKT
 251 QTLHKFILLF AVFDEGKSWH SETKNSLMQD RDAASARAWP KMHTVNGYVN
 301 RSLPGLIGCH RKSVYWHVIG MGTTPEVHSI FLEGHTFLVR NHRQASLEIS
 351 PITFLTAQTL LMDLGQFLLF CHISSHQHDG MEAYVKVDSC PEEPQLRMKN
 401 NEEAEDYDDD LTDSEMDVVR FDDDNSPSFI QIRSVAKKHP KTWVHYIAAE
 451 EEDWDYAPLV LAPDDRSYKS QYLNNGPQRI GRKYKKVRFM AYTDETFKTR
 501 EAIQHESGIL GPLLYGEVGD TLLIIFKNQA SRPYNIYPHG ITDVRPLYSR
 551 RLPKGVKHLK DFPILPGEIF KYKWTVTVED GPTKSDPRCL TRYYSSFVNM
 601 ERDLASGLIG PLLICYKESV DQRGNQIMSD KRNVILFSVF DENRSWYLTE
 651 NIQRFLPNPA GVQLEDPEFQ ASNIMHSING YVFDSLQLSV CLHEVAYWYI
 701 LSIGAQTDFL SVFFSGYTFK HKMVYEDTLT LFPFSGETVF MSMENPGLWI
 751 LGCHNSDFRN RGMTALLKVS SCDKNTGDYY EDSYEDISAY LLSKNNAIEP
 801 RSFSQNGAPG TSESATPESG PGSEPATSGS ETPGTSESAT PESGPGSEPA
 851 TSGSETPGTS ESATPESGPG TSTEPSEGSA PGSPAGSPTS TEEGTSESAT
 901 PESGPGSEPA TSGSETPGTS ESATPESGPG SPAGSPTSTE EGSPAGSPTS
 951 TEEGTSTEPS EGSAPGTSES ATPESGPGTS ESATPESGPG TSESATPESG
1001 PGSEPATSGS ETPGSEPATS GSETPGSPAG SPTSTEEGTS TEPSEGSAPG
1051 TSTEPSEGSA PGSEPATSGS ETPGTSESAT PESGPGTSTE PSEGSAPASS
1101 PPVLKRHQAE ITRTTLQSDQ EEIDYDDTIS VEMKKEDFDI YDEDENQSPR
1151 SFQKKTRHYF IAAVERLWDY GMSSSPHVLR NRAQSGSVPQ FKKVVFQEFT
1201 DGSFTQPLYR GELNEHLGLL GPYIRAEVED NIMVTFRNQA SRPYSFYSSL
1251 ISYEEDQRQG AEPRKNFVKP NETKTYFWKV QHHMAPTKDE FDCKAWAYFS
1301 DVDLEKDVHS GLIGPLLVCH TNTLNPAHGR QVTVQEFALF FTIFDETKSW
1351 YFTENMERNC RAPCNIQMED PTFKENYRFH AINGYIMDTL PGLVMAQDQR
1401 IRWYLLSMGS NENIHSIHFS GHVFTVRKKE EYKMALYNLY PGVFETVEML
1451 PSKAGIWRVE CLIGEHLHAG MSTLFLVYSN KCQTPLGMAS GHIRDFQITA
1501 SGQYGQWAPK LARLHYSGSI NAWSTKEPFS WIKVDLLAPM IIHGIKTQGA
1551 RQKFSSLYIS QFIIMYSLDG KKWQTYRGNS TGTLMVFFGN VDSSGIKHNI
1601 FNPPIIARYI RLHPTHYSIR STLRMELMGC DLNSCSMPLG MESKAISDAQ
1651 ITASSYFTNM FATWSPSKAR LHLQGRSNAW RPQVNNPKEW LQVDFQKTMK
1701 VTGVTTQGVK SLLTSMYVKE FLISSSQDGH QWTLFFQNGK VKVFQGNQDS
1751 FTPVVNSLDP PLLTRYLRIH PQSWVHQIAL RMEVLGCEAQ DLYDKTHTCP
1801 PCPAPELLGG PSVFLFPPKP KDTLMISRTP EVTCVVVDVS HEDPEVKFNW
1851 YVDGVEVHNA KTKPREEQYN STYRVVSVLT VLHQDWLNGK EYKCKVSNKA
```

```
1901 LPAPIEKTIS KAKGQPREPQ VYTLPPSRDE LTKNQVSLTC LVKGFYPSDI

1951 AVEWESNGQP ENNYKTTPPV LDSDGSFFLY SKLTVDKSRW QQGNVFSCSV

2001 MHEALHNHYT QKSLSLSPGK *
``` pSYN FVIII 267 Protein Sequence (FVIII Fc with 72 AE-XTEN at Amino Acid 18 and 288 AE XTEN in B-Domain) SEQ ID NO: 81)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGASSSDLGE LPVDARFPPR VPKSFPFNTS VVYKKTLFVE

151 FTDHLFNIAK PRPPWMGLLG PTIQAEVYDT VVITLKNMAS HPVSLHAVGV

201 SYWKASEGAE YDDQTSQREK EDDKVFPGGS HTYVWQVLKE NGPMASDPLC

251 LTYSYLSHVD LVKDLNSGLI GALLVCREGS LAKEKTQTLH KFILLFAVFD

301 EGKSWHSETK NSLMQDRDAA SARAWPKMHT VNGYVNRSLP GLIGCHRKSV

351 YWHVIGMGTT PEVHSIFLEG HTFLVRNHRQ ASLEISPITF LTAQTLLMDL

401 GQFLLFCHIS SHQHDGMEAY VKVDSCPEEP QLRMKNNEEA EDYDDDLTDS

451 EMDVVRFDDD NSPSFIQIRS VAKKHPKTWV HYIAAEEEDW DYAPLVLAPD

501 DRSYKSQYLN NGPQRIGRKY KKVRFMAYTD ETFKTREAIQ HESGILGPLL

551 YGEVGDTLLI IFKNQASRPY NIYPHGITDV RPLYSRRLPK GVKHLKDFPI

601 LPGEIFKYKW TVTVEDGPTK SDPRCLTRYY SSFVNMERDL ASGLIGPLLI

651 CYKESVDQRG NQIMSDKRNV ILFSVFDENR SWYLTENIQR FLPNPAGVQL

701 EDPEFQASNI MHSINGYVFD SLQLSVCLHE VAYWYILSIG AQTDFLSVFF

751 SGYTFKHKMV YEDTLTLFPF SGETVFMSME NPGLWILGCH NSDFRNRGMT

801 ALLKVSSCDK NTGDYYEDSY EDISAYLLSK NNAIEPRSFS QNGAPGTSES

851 ATPESGPGSE PATSGSETPG TSESATPESG PGSEPATSGS ETPGTSESAT

901 PESGPGTSTE PSEGSAPGSP AGSPTSTEEG TSESATPESG PGSEPATSGS

951 ETPGTSESAT PESGPGSPAG SPTSTEEGSP AGSPTSTEEG TSTEPSEGSA

1001 PGTSESATPE SGPGTSESAT PESGPGTSES ATPESGPGSE PATSGSETPG

1051 SEPATSGSET PGSPAGSPTS TEEGTSTEPS EGSAPGTSTE PSEGSAPGSE

1101 PATSGSETPG TSESATPESG PGTSTEPSEG SAPASSPPVL KRHQAEITRT

1151 TLQSDQEEID YDDTISVEMK KEDFDIYDED ENQSPRSFQK KTRHYFIAAV

1201 ERLWDYGMSS SPHVLRNRAQ SGSVPQFKKV VFQEFTDGSF TQPLYRGELN

1251 EHLGLLGPYI RAEVEDNIMV TFRNQASRPY SFYSSLISYE EDQRQGAEPR

1301 KNFVKPNETK TYFWKVQHHM APTKDEFDCK AWAYFSDVDL EKDVHSGLIG

1351 PLLVCHTNTL NPAHGRQVTV QEFALFFTIF DETKSWYFTE NMERNCRAPC

1401 NIQMEDPTFK ENYRFHAING YIMDTLPGLV MAQDQRIRWY LLSMGSNENI

1451 HSIHFSGHVF TVRKKEEYKM ALYNLYPGVF ETVEMLPSKA GIWRVECLIG

1501 EHLHAGMSTL FLVYSNKCQT PLGMASGHIR DFQITASGQY GQWAPKLARL

1551 HYSGSINAWS TKEPFSWIKV DLLAPMIIHG IKTQGARQKF SSLYISQFII

1601 MYSLDGKKWQ TYRGNSTGTL MVFFGNVDSS GIKHNIFNPP IIARYIRLHP

1651 THYSIRSTLR MELMGCDLNS CSMPLGMESK AISDAQITAS SYFTNMFATW
```

```
1701 SPSKARLHLQ GRSNAWRPQV NNPKEWLQVD FQKTMKVTGV TTQGVKSLLT

1751 SMYVKEFLIS SSQDGHQWTL FFQNGKVKVF QGNQDSFTPV VNSLDPPLLT

1801 RYLRIHPQSW VHQIALRMEV LGCEAQDLYD KTHTCPPCPA PELLGGPSVF

1851 LFPPKPKDTL MISRTPEVTC VVVDVSHEDP EVKFNWYVDG VEVHNAKTKP

1901 REEQYNSTYR VVSVLTVLHQ DWLNGKEYKC KVSNKALPAP IEKTISKAKG

1951 QPREPQVYTL PPSRDELTKN QVSLTCLVKG FYPSDIAVEW ESNGQPENNY

2001 KTTPPVLDSD GSFFLYSKLT VDKSRWQQGN VFSCSVMHEA LHNHYTQKSL

2051 SLSPGK*
``` pSYN FVIII 268 Protein Sequence (FVIII Fc with 144 AE-XTEN at Amino Acid 18) SEQ ID NO: 82)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGSPAGSPTS TEEGTSESAT PESGPGSEPA TSGSETPGTS

151 ESATPESGPG SPAGSPTSTE EGSPAGSPTS TEEGASSSDL GELPVDARFP

201 PRVPKSFPFN TSVVYKKTLF VEFTDHLFNI AKPRPPWMGL LGPTIQAEVY

251 DTVVITLKNM ASHPVSLHAV GVSYWKASEG AEYDDQTSQR EKEDDKVFPG

301 GSHTYVWQVL KENGPMASDP LCLTYSYLSH VDLVKDLNSG LIGALLVCRE

351 GSLAKEKTQT LHKFILLFAV FDEGKSWHSE TKNSLMQDRD AASARAWPKM

401 HTVNGYVNRS LPGLIGCHRK SVYWHVIGMG TTPEVHSIFL EGHTFLVRNH

451 RQASLEISPI TFLTAQTLLM DLGQFLLFCH ISSHQHDGME AYVKVDSCPE

501 EPQLRMKNNE EAEDYDDDLT DSEMDVVRFD DDNSPSFIQI RSVAKKHPKT

551 WVHYIAAEEE DWDYAPLVLA PDDRSYKSQY LNNGPQRIGR KYKKVRFMAY

601 TDETFKTREA IQHESGILGP LLYGEVGDTL LIIFKNQASR PYNIYPHGIT

651 DVRPLYSRRL PKGVKHLKDF PILPGEIFKY KWTVTVEDGP TKSDPRCLTR

701 YYSSFVNMER DLASGLIGPL LICYKESVDQ RGNQIMSDKR NVILFSVFDE

751 NRSWYLTENI QRFLPNPAGV QLEDPEFQAS NIMHSINGYV FDSLQLSVCL

801 HEVAYWYILS IGAQTDFLSV FFSGYTFKHK MVYEDTLTLF PFSGETVFMS

851 MENPGLWILG CHNSDFRNRG MTALLKVSSC DKNTGDYYED SYEDISAYLL

901 SKNNAIEPRS FSQNPPVLKR HQAEITRTTL QSDQEEIDYD DTISVEMKKE

951 DFDIYDEDEN QSPRSFQKKT RHYFIAAVER LWDYGMSSSP HVLRNRAQSG

1001 SVPQFKKVVF QEFTDGSFTQ PLYRGELNEH LGLLGPYIRA EVEDNIMVTF

1051 RNQASRPYSF YSSLISYEED QRQGAEPRKN FVKPNETKTY FWKVQHHMAP

1101 TKDEFDCKAW AYFSDVDLEK DVHSGLIGPL LVCHTNTLNP AHGRQVTVQE

1151 FALFFTIFDE TKSWYFTENM ERNCRAPCNI QMEDPTFKEN YRFHAINGYI

1201 MDTLPGLVMA QDQRIRWYLL SMGSNENIHS IHFSGHVFTV RKKEEYKMAL

1251 YNLYPGVFET VEMLPSKAGI WRVECLIGEH LHAGMSTLFL VYSNKCQTPL

1301 GMASGHIRDF QITASGQYGQ WAPKLARLHY SGSINAWSTK EPFSWIKVDL

1351 LAPMIIHGIK TQGARQKFSS LYISQFIIMY SLDGKKWQTY RGNSTGTLMV

1401 FFGNVDSSGI KHNIFNPPII ARYIRLHPTH YSIRSTLRME LMGCDLNSCS

1451 MPLGMESKAI SDAQITASSY FTNMFATWSP SKARLHLQGR SNAWRPQVNN
```

-continued

```
1501 PKEWLQVDFQ KTMKVTGVTT QGVKSLLTSM YVKEFLISSS QDGHQWTLFF

1551 QNGKVKVFQG NQDSFTPVVN SLDPPLLTRY LRIHPQSWVH QIALRMEVLG

1601 CEAQDLYDKT HTCPPCPAPE LLGGPSVFLF PPKPKDTLMI SRTPEVTCVV

1651 VDVSHEDPEV KFNWYVDGVE VHNAKTKPRE EQYNSTYRVV SVLTVLHQDW

1701 LNGKEYKCKV SNKALPAPIE KTISKAKGQP REPQVYTLPP SRDELTKNQV

1751 SLTCLVKGFY PSDIAVEWES NGQPENNYKT TPPVLDSDGS FFLYSKLTVD

1801 KSRWQQGNVF SCSVMHEALH NHYTQKSLSL SPGK*
``` pSYN FVIII 269 Protein Sequence (FVIII Fc with 72 AE-XTEN at Amino Acid 18) SEQ ID NO: 83)

```
   1 MQIELSTCFF LCLLRFCFSA TRRYYLGAVE LSWDYMQGAP TSESATPESG

51 PGSEPATSGS ETPGTSESAT PESGPGSEPA TSGSETPGTS ESATPESGPG

101 TSTEPSEGSA PGASSSDLGE LPVDARFPPR VPKSFPFNTS VVYKKTLFVE

151 FTDHLFNIAK PRPPWMGLLG PTIQAEVYDT VVITLKNMAS HPVSLHAVGV

201 SYWKASEGAE YDDQTSQREK EDDKVFPGGS HTYVWQVLKE NGPMASDPLC

251 LTYSYLSHVD LVKDLNSGLI GALLVCREGS LAKEKTQTLH KFILLFAVFD

301 EGKSWHSETK NSLMQDRDAA SARAWPKMHT VNGYVNRSLP GLIGCHRKSV

351 YWHVIGMGTT PEVHSIFLEG HTFLVRNHRQ ASLEISPITF LTAQTLLMDL

401 GQFLLFCHIS SHQHDGMEAY VKVDSCPEEP QLRMKNNEEA EDYDDDLTDS

451 EMDVVRFDDD NSPSFIQIRS VAKKHPKTWV HYIAAEEEDW DYAPLVLAPD

501 DRSYKSQYLN NGPQRIGRKY KKVRFMAYTD ETFKTREAIQ HESGILGPLL

551 YGEVGDTLLI IFKNQASRPY NIYPHGITDV RPLYSRRLPK GVKHLKDFPI

601 LPGEIFKYKW TVTVEDGPTK SDPRCLTRYY SSFVNMERDL ASGLIGPLLI

651 CYKESVDQRG NQIMSDKRNV ILFSVFDENR SWYLTENIQR FLPNPAGVQL

701 EDPEFQASNI MHSINGYVFD SLQLSVCLHE VAYWYILSIG AQTDFLSVFF

751 SGYTFKHKMV YEDTLTLFPF SGETVFMSME NPGLWILGCH NSDFRNRGMT

801 ALLKVSSCDK NTGDYYEDSY EDISAYLLSK NNAIEPRSFS QNPPVLKRHQ

851 AEITRTTLQS DQEEIDYDDT ISVEMKKEDF DIYDEDENQS PRSFQKKTRH

901 YFIAAVERLW DYGMSSSPHV LRNRAQSGSV PQFKKVVFQE FTDGSFTQPL

951 YRGELNEHLG LLGPYIRAEV EDNIMVTFRN QASRPYSFYS SLISYEEDQR

1001 QGAEPRKNFV KPNETKTYFW KVQHHMAPTK DEFDCKAWAY FSDVDLEKDV

1051 HSGLIGPLLV CHTNTLNPAH GRQVTVQEFA LFFTIFDETK SWYFTENMER

1101 NCRAPCNIQM EDPTFKENYR FHAINGYIMD TLPGLVMAQD QRIRWYLLSM

1151 GSNENIHSIH FSGHVFTVRK KEEYKMALYN LYPGVFETVE MLPSKAGIWR

1201 VECLIGEHLH AGMSTLFLVY SNKCQTPLGM ASGHIRDFQI TASGQYGQWA

1251 PKLARLHYSG SINAWSTKEP FSWIKVDLLA PMIIHGIKTQ GARQKFSSLY

1301 ISQFIIMYSL DGKKWQTYRG NSTGTLMVFF GNVDSSGIKH NIFNPPIIAR

1351 YIRLHPTHYS IRSTLRMELM GCDLNSCSMP LGMESKAISD AQITASSYFT

1401 NMFATWSPSK ARLHLQGRSN AWRPQVNNPK EWLQVDFQKT MKVTGVTTQG

1451 VKSLLTSMYV KEFLISSSQD GHQWTLFFQN GKVKVFQGNQ DSFTPVVNSL
```

```
1501 DPPLLTRYLR IHPQSWVHQI ALRMEVLGCE AQDLYDKTHT CPPCPAPELL

1551 GGPSVFLFPP KPKDTLMISR TPEVTCVVVD VSHEDPEVKF NWYVDGVEVH

1601 NAKTKPREEQ YNSTYRVVSV LTVLHQDWLN GKEYKCKVSN KALPAPIEKT

1651 ISKAKGQPRE PQVYTLPPSR DELTKNQVSL TCLVKGFYPS DIAVEWESNG

1701 QPENNYKTTP PVLDSDGSFF LYSKLTVDKS RWQQGNVFSC SVMHEALHNH

1751 YTQKSLSLSP GK*
``` pSYNFVIII 271 Protein Sequence (FVIII Fc with 42 AE-XTEN at Amino Acid 18) SEQ ID NO: 84)

```
   1 MQIELSTCFF LCLLRFCFSA TRRYYLGAVE LSWDYMQGAP GSPAGSPTST

51 EEGTSESATP ESGPGSEPAT SGSETPASSS DLGELPVDAR FPPRVPKSFP

101 FNTSVVYKKT LFVEFTDHLF NIAKPRPPWM GLLGPTIQAE VYDTVVITLK

151 NMASHPVSLH AVGVSYWKAS EGAEYDDQTS QREKEDDKVF PGGSHTYVWQ

201 VLKENGPMAS DPLCLTYSYL SHVDLVKDLN SGLIGALLVC REGSLAKEKT

251 QTLHKFILLF AVFDEGKSWH SETKNSLMQD RDAASARAWP KMHTVNGYVN

301 RSLPGLIGCH RKSVYWHVIG MGTTPEVHSI FLEGHTFLVR NHRQASLEIS

351 PITFLTAQTL LMDLGQFLLF CHISSHQHDG MEAYVKVDSC PEEPQLRMKN

401 NEEAEDYDDD LTDSEMDVVR FDDDNSPSFI QIRSVAKKHP KTWVHYIAAE

451 EEDWDYAPLV LAPDDRSYKS QYLNNGPQRI GRKYKKVRFM AYTDETFKTR

501 EAIQHESGIL GPLLYGEVGD TLLIIFKNQA SRPYNIYPHG ITDVRPLYSR

551 RLPKGVKHLK DFPILPGEIF KYKWTVTVED GPTKSDPRCL TRYYSSFVNM

601 ERDLASGLIG PLLICYKESV DQRGNQIMSD KRNVILFSVF DENRSWYLTE

651 NIQRFLPNPA GVQLEDPEFQ ASNIMHSING YVFDSLQLSV CLHEVAYWYI

701 LSIGAQTDFL SVFFSGYTFK HKMVYEDTLT LFPFSGETVF MSMENPGLWI

751 LGCHNSDFRN RGMTALLKVS SCDKNTGDYY EDSYEDISAY LLSKNNAIEP

801 RSFSQNPPVL KRHQAEITRT TLQSDQEEID YDDTISVEMK KEDFDIYDED

851 ENQSPRSFQK KTRHYFIAAV ERLWDYGMSS SPHVLRNRAQ SGSVPQFKKV

901 VFQEFTDGSF TQPLYRGELN EHLGLLGPYI RAEVEDNIMV TFRNQASRPY

951 SFYSSLISYE EDQRQGAEPR KNFVKPNETK TYFWKVQHHM APTKDEFDCK

1001 AWAYFSDVDL EKDVHSGLIG PLLVCHTNTL NPAHGRQVTV QEFALFFTIF

1051 DETKSWYFTE NMERNCRAPC NIQMEDPTFK ENYRFHAING YIMDTLPGLV

1101 MAQDQRIRWY LLSMGSNENI HSIHFSGHVF TVRKKEEYKM ALYNLYPGVF

1151 ETVEMLPSKA GIWRVECLIG EHLHAGMSTL FLVYSNKCQT PLGMASGHIR

1201 DFQITASGQY GQWAPKLARL HYSGSINAWS TKEPFSWIKV DLLAPMIIHG

1251 IKTQGARQKF SSLYISQFII MYSLDGKKWQ TYRGNSTGTL MVFFGNVDSS

1301 GIKHNIFNPP IIARYIRLHP THYSIRSTLR MELMGCDLNS CSMPLGMESK

1351 AISDAQITAS SYFTNMFATW SPSKARLHLQ GRSNAWRPQV NNPKEWLQVD

1401 FQKTMKVTGV TTQGVKSLLT SMYVKEFLIS SSQDGHQWTL FFQNGKVKVF

1451 QGNQDSFTPV VNSLDPPLLT RYLRIHPQSW VHQIALRMEV LGCEAQDLYD

1501 KTHTCPPCPA PELLGGPSVF LFPPKPKDTL MISRTPEVTC VVVDVSHEDP

1551 EVKFNWYVDG VEVHNAKTKP REEQYNSTYR VVSVLTVLHQ DWLNGKEYKC
```

-continued

```
1601  KVSNKALPAP IEKTISKAKG QPREPQVYTL PPSRDELTKN QVSLTCLVKG

1651  FYPSDIAVEW ESNGQPENNY KTTPPVLDSD GSFFLYSKLT VDKSRWQQGN

1701  VFSCSVMHEA LHNHYTQKSL SLSPGK*
``` pSYN FVIII Protein Sequence 272 (FVIII with 144 AE XTEN at Amino Acid 18 and 244 AE XTEN in B-Domain-No Fc) SEQ ID NO: 85)

```
   1  MQIELSTCFF LCLLRFCFSA TRRYYLGAVE LSWDYMQGAP TSESATPESG

51  PGSEPATSGS ETPGTSESAT PESGPGSEPA TSGSETPGTS ESATPESGPG

101  TSTEPSEGSA PGSPAGSPTS TEEGTSESAT PESGPGSEPA TSGSETPGTS

151  ESATPESGPG SPAGSPTSTE EGSPAGSPTS TEEGASSSDL GELPVDARFP

201  PRVPKSFPFN TSVVYKKTLF VEFTDHLFNI AKPRPPWMGL LGPTIQAEVY

251  DTVVITLKNM ASHPVSLHAV GVSYWKASEG AEYDDQTSQR EKEDDKVFPG

301  GSHTYVWQVL KENGPMASDP LCLTYSYLSH VDLVKDLNSG LIGALLVCRE

351  GSLAKEKTQT LHKFILLFAV FDEGKSWHSE TKNSLMQDRD AASARAWPKM

401  HTVNGYVNRS LPGLIGCHRK SVYWHVIGMG TTPEVHSIFL EGHTFLVRNH

451  RQASLEISPI TFLTAQTLLM DLGQFLLFCH ISSHQHDGME AYVKVDSCPE

501  EPQLRMKNNE EAEDYDDDLT DSEMDVVRFD DDNSPSFIQI RSVAKKHPKT

551  WVHYIAAEEE DWDYAPLVLA PDDRSYKSQY LNNGPQRIGR KYKKVRFMAY

601  TDETFKTREA IQHESGILGP LLYGEVGDTL LIIFKNQASR PYNIYPHGIT

651  DVRPLYSRRL PKGVKHLKDF PILPGEIFKY KWTVTVEDGP TKSDPRCLTR

701  YYSSFVNMER DLASGLIGPL LICYKESVDQ RGNQIMSDKR NVILFSVFDE

751  NRSWYLTENI QRFLPNPAGV QLEDPEFQAS NIMHSINGYV FDSLQLSVCL

801  HEVAYWYILS IGAQTDFLSV FFSGYTFKHK MVYEDTLTLF PFSGETVFMS

851  MENPGLWILG CHNSDFRNRG MTALLKVSSC DKNTGDYYED SYEDISAYLL

901  SKNNAIEPRS FSQNGAPGTS ESATPESGPG SEPATSGSET PGTSESATPE

951  SGPGSEPATS GSETPGTSES ATPESGPGTS TEPSEGSAPG SPAGSPTSTE

1001  EGTSESATPE SGPGSEPATS GSETPGTSES ATPESGPGSP AGSPTSTEEG

1051  SPAGSPTSTE EGTSTEPSEG SAPGTSESAT PESGPGTSES ATPESGPGTS

1101  ESATPESGPG SEPATSGSET PGSEPATSGS ETPGSPAGSP TSTEEGTSTE

1151  PSEGSAPGTS TEPSEGSAPG SEPATSGSET PGTSESATPE SGPGTSTEPS

1201  EGSAPASSPP VLKRHQAEIT RTTLQSDQEE IDYDDTISVE MKKEDFDIYD

1251  EDENQSPRSF QKKTRHYFIA AVERLWDYGM SSSPHVLRNR AQSGSVPQFK

1301  KVVFQEFTDG SFTQPLYRGE LNEHLGLLGP YIRAEVEDNI MVTFRNQASR

1351  PYSFYSSLIS YEEDQRQGAE PRKNFVKPNE TKTYFWKVQH HMAPTKDEFD

1401  CKAWAYFSDV DLEKDVHSGL IGPLLVCHTN TLNPAHGRQV TVQEFALFFT

1451  IFDETKSWYF TENMERNCRA PCNIQMEDPT FKENYRFHAI NGYIMDTLPG

1501  LVMAQDQRIR WYLLSMGSNE NIHSIHFSGH VFTVRKKEEY KMALYNLYPG

1551  VFETVEMLPS KAGIWRVECL IGEHLHAGMS TLFLVYSNKC QTPLGMASGH

1601  IRDFQITASG QYGQWAPKLA RLHYSGSINA WSTKEPFSWI KVDLLAPMII

1651  HGIKTQGARQ KFSSLYISQF IIMYSLDGKK WQTYRGNSTG TLMVFFGNVD
```

```
1701 SSGIKHNIFN PPIIARYIRL HPTHYSIRST LRMELMGCDL NSCSMPLGME

1751 SKAISDAQIT ASSYFTNMFA TWSPSKARLH LQGRSNAWRP QVNNPKEWLQ

1801 VDFQKTMKVT GVTTQGVKSL LTSMYVKEFL ISSSQDGHQW TLFFQNGKVK

1851 VFQGNQDSFT PVVNSLDPPL LTRYLRIHPQ SWVHQIALRM EVLGCEAQDL

1901 Y*
``` pSYN-FVIII-161 Protein Sequence (SEQ ID NO: 69) (FVIII sequence amino acid position 1-1457; underlined region represents Fc region; curvy underline represents cleavable linker in between first Fc and VWF fragment; double underlined region represents VWF fragment; bold region represents cleavable linker in between VWF fragment and Fc).

```
   1 MQIELSTCFF LCLLRFCFSA TRRYYLGAVE LSWDYMQSDL GELPVDARFP

51 PRVPKSFPFN TSVVYKKTLF VEFTDHLFNI AKPRPPWMGL LGPTIQAEVY

101 DTVVITLKNM ASHPVSLHAV GVSYWKASEG AEYDDQTSQR EKEDDKVFPG

151 GSHTYVWQVL KENGPMASDP LCLTYSYLSH VDLVKDLNSG LIGALLVCRE

201 GSLAKEKTQT LHKFILLFAV FDEGKSWHSE TKNSLMQDRD AASARAWPKM

251 HTVNGYVNRS LPGLIGCHRK SVYWHVIGMG TTPEVHSIFL EGHTFLVRNH

301 RQASLEISPI TFLTAQTLLM DLGQFLLFCH ISSHQHDGME AYVKVDSCPE

351 EPQLRMKNNE EAEDYDDDLT DSEMDVVRFD DDNSPSFIQI RSVAKKHPKT

401 WVHYIAAEEE DWDYAPLVLA PDDRSYKSQY LNNGPQRIGR KYKKVRFMAY

451 TDETFKTREA IQHESGILGP LLYGEVGDTL LIIFKNQASR PYNIYPHGIT

501 DVRPLYSRRL PKGVKHLKDF PILPGEIFKY KWTVTVEDGP TKSDPRCLTR

551 YYSSFVNMER DLASGLIGPL LICYKESVDQ RGNQIMSDKR NVILFSVFDE

601 NRSWYLTENI QRFLPNPAGV QLEDPEFQAS NIMHSINGYV FDSLQLSVCL

651 HEVAYWYILS IGAQTDFLSV FFSGYTFKHK MVYEDTLTLF PFSGETVFMS

701 MENPGLWILG CHNSDFRNRG MTALLKVSSC DKNTGDYYED SYEDISAYLL

751 SKNNAIEPRS FSQNPPVLKR HQREITRTTL QSDQEEIDYD DTISVEMKKE

801 DFDIYDEDEN QSPRSFQKKT RHYFIAAVER LWDYGMSSSP HVLRNRAQSG

851 SVPQFKKVVF QEFTDGSFTQ PLYRGELNEH LGLLGPYIRA EVEDNIMVTF

901 RNQASRPYSF YSSLISYEED QRQGAEPRKN FVKPNETKTY FWKVQHHMAP

951 TKDEFDCKAW AYFSDVDLEK DVHSGLIGPL LVCHTNTLNP AHGRQVTVQE

1001 FALFFTIFDE TKSWYFTENM ERNCRAPCNI QMEDPTFKEN YRFHAINGYI

1051 MDTLPGLVMA QDQRIRWYLL SMGSNENIHS IHFSGHVFTV RKKEEYKMAL

1101 YNLYPGVFET VEMLPSKAGI WRVECLIGEH LHAGMSTLFL VYSNKCQTPL

1151 GMASGHIRDF QITASGQYGQ WAPKLARLHY SGSINAWSTK EPFSWIKVDL

1201 LAPMIIHGIK TQGARQKFSS LYISQFIIMY SLDGKKWQTY RGNSTGTLMV

1251 FFGNVDSSGI KHNIFNPPII ARYIRLHPTH YSIRSTLRME LMGCDLNSCS

1301 MPLGMESKAI SDAQITASSY FTNMFATWSP SKARLHLQGR SNAWRPQVNN

1351 PKEWLQVDFQ KTMKVTGVTT QGVKSLLTSM YVKEFLISSS QDGHQWTLFF

1401 QNGKVKVFQG NQDSFTPVVN SLDPPLLTRY LRIHPQSWVH QIALRMEVLG

1451 CEAQDLYDKT HTCPPCPAPE LLGGPSVFLF PPKPKDTLMI SRTPEVTCVV

1501 VDVSHEDPEV KFNWYVDGVE VHNAKTKPRE EQYNSTYRVV SVLTVLHQDW
```

-continued

```
1551 LNGKEYKCKV SNKALPAPIE KTISKAKGQP REPQVYTLPP SRDELTKNQV

1601 SLTCLVKGFY PSDIAVEWES NGQPENNYKT TPPVLDSDGS FFLYSKLTVD

1651 KSRWQQGNVF SCSVMHEALH NHYTQKSLSL SPGKRRRRSG GGGSGGGGSG

1701 GGGSGGGGSG GGGSGGGGSR KRRKRSLSCR PPMVKLVCPA DNLRAEGLEC

1751 TKTCQNYDLE CMSMGCVSGC LCPPGMVRHE NRCVALERCP CFHQGKEYAP

1801 GETVKIGCNT CVCRDRKWNC TDHVCDATCS TIGMAHYLTF DGLKYLFPGE

1851 CQYVLVQDYC GSNPGTFRIL VGNKGCSHPS VKCKKRVTIL VEGGEIELFD

1901 GEVNVKRPMK DETHFEVVES GRYIILLLGK ALSVVWDRHL SISVVLKQTY

1951 QEKVCGLCGN FDGIQNNDLT SSNLQVEEDP VDFGNSWKVS SQCADTRKVP

2001 LDSSPATCHN NIMKQTMVDS SCRILTSDVF QDCNKLVDPE PYLDVCIYDT

2051 CSCESIGDCA AFCDTIAAYA HVCAQHGKVV TWRTATLCPQ SCEERNLREN

2101 GYEAEWRYNS CAPACQVTCQ HPEPLACPVQ CVEGCHAHCP PGKILDELLQ

2151 TCVDPEDCPV CEVAGRRFAS GKKVTLNPSD PEHCQICHCD VVNLTCEACQ

2201 EPISGTSESA TPESGPGSEP ATSGSETPGT SESATPESGP GSEPATSGSE

2251 TPGTSESATP ESGPGTSTEP SEGSAPGSPA GSPTSTEEGT SESATPESGP

2301 GSEPATSGSE TPGTSESATP ESGPGSPAGS PTSTEEGSPA GSPTSTEEGT

2351 STEPSEGSAP GTSESATPES GPGTSESATP ESGPGTSESA TPESGPGSEP

2401 ATSGSETPGS EPATSGSETP GSPAGSPTST EEGTSTEPSE GSAPGTSTEP

2451 SEGSAPGSEP ATSGSETPGT SESATPESGP GTSTEPSEGS APDSGGGGSG

2501 GGGSGGGGSG GGGSGGGGSL VPRGSGGDKT HTCPPCPAPE LLGGPSVFLF

2551 PPKPKDTLMI SRTPEVTCVV VDVSHEDPEV KFNWYVDGVE VHNAKTKPRE

2601 EQYNSTYRVV SVLTVLHQDW LNGKEYKCKV SNKALPAPIE KTISKAKGQP

2651 REPQVYTLPP SRDELTKNQV SLTCLVKGFY PSDIAVEWES NGQPENNYKT

2701 TPPVLDSDGS FFLYSKLTVD KSRWQQGNVF SCSVMHEALH NHYTQKSLSL

2751 SPGK
``` pSYN-FVIII-170 Protein Sequence (SEQ ID NO: 71)

```
  1 SLSCRPPMVK LVCPADNLRA EGLECTKTCQ NYDLECMSMG CVSGCLCPPG

51 MVRHENRCVA LERCPCFHQG KEYAPGETVK IGCNTCVCRD RKWNCTDHVC

101 DATCSTIGMA HYLTFDGLKY LFPGECQYVL VQDYCGSNPG TFRILVGNKG

151 CSHPSVKCKK RVTILVEGGE IELFDGEVNV KRPMKDETHF EVVESGRYII

201 LLLGKALSVV WDRHLSISVV LKQTYQEKVC GLCGNFDGIQ NNDLTSSNLQ

251 VEEDPVDFGN SWKVSSQCAD TRKVPLDSSP ATCHNNIMKQ TMVDSSCRIL

301 TSDVFQDCNK LVDPEPYLDV CIYDTCSCES IGDCAAFCDT IAAYAHVCAQ

351 HGKVVTWRTA TLCPQSCEER NLRENGYEAE WRYNSCAPAC QVTCQHPEPL

401 ACPVQCVEGC HAHCPPGKIL DELLQTCVDP EDCPVCEVAG RRFASGKKVT

451 LNPSDPEHCQ ICHCDVVNLT CEACQEPISG TSESATPESG PGSEPATSGS

501 ETPGTSESAT PESGPGSEPA TSGSETPGTS ESATPESGPG TSTEPSEGSA

551 PGSPAGSPTS TEEGTSESAT PESGPGSEPA TSGSETPGTS ESATPESGPG

601 SPAGSPTSTE EGSPAGSPTS TEEGTSTEPS EGSAPGTSES ATPESGPGTS
```

-continued

```
 651  ESATPESGPG TSESATPESG PGSEPATSGS ETPGSEPATS GSETPGSPAG

701  SPTSTEEGTS TEPSEGSAPG TSTEPSEGSA PGSEPATSGS ETPGTSESAT

751  PESGPGTSTE PSEGSAPDSG GGGSGGGGSG GGGSGGGGSG GGGSLVPRGS

801  GGASATRRYY LGAVELSWDY MQSDLGELPV DARFPPRVPK SFPFNTSVVY

851  KKTLFVEFTD HLFNIAKPRP PWMGLLGPTI QAEVYDTVVI TLKNMASHPV

901  SLHAVGVSYW KASEGAEYDD QTSQREKEDD KVFPGGSHTY VWQVLKENGP

951  MASDPLCLTY SYLSHVDLVK DLNSGLIGAL LVCREGSLAK EKTQTLHKFI

1001  LLFAVFDEGK SWHSETKNSL MQDRDAASAR AWPKMHTVNG YVNRSLPGLI

1051  GCHRKSVYWH VIGMGTTPEV HSIFLEGHTF LVRNHRQASL EISPITFLTA

1101  QTLLMDLGQF LLFCHISSHQ HDGMEAYVKV DSCPEEPQLR MKNNEEAEDY

1151  DDDLTDSEMD VVRFDDDNSP SFIQIRSVAK KHPKTWVHYI AAEEEDWDYA

1201  PLVLAPDDRS YKSQYLNNGP QRIGRKYKKV RFMAYTDETF KTREAIQHES

1251  GILGPLLYGE VGDTLLIIFK NQASRPYNIY PHGITDVRPL YSRRLPKGVK

1301  HLKDFPILPG EIFKYKWTVT VEDGPTKSDP RCLTRYYSSF VNMERDLASG

1351  LIGPLLICYK ESVDQRGNQI MSDKRNVILF SVFDENRSWY LTENIQRFLP

1401  NPAGVQLEDP EFQASNIMHS INGYVFDSLQ LSVCLHEVAY WYILSIGAQT

1451  DFLSVFFSGY TFKHKMVYED TLTLFPFSGE TVFMSMENPG LWILGCHNSD

1501  FRNRGMTALL KVSSCDKNTG DYYEDSYEDI SAYLLSKNNA IEPRSFSQNP

1551  PVLKRHQREI TRTTLQSDQE EIDYDDTISV EMKKEDFDIY DEDENQSPRS

1601  FQKKTRHYFI AAVERLWDYG MSSSPHVLRN RAQSGSVPQF KKVVFQEFTD

1651  GSFTQPLYRG ELNEHLGLLG PYIRAEVEDN IMVTFRNQAS RPYSFYSSLI

1701  SYEEDQRQGA EPRKNFVKPN ETKTYFWKVQ HHMAPTKDEF DCKAWAYFSD

1751  VDLEKDVHSG LIGPLLVCHT NTLNPAHGRQ VTVQEFALFF TIFDETKSWY

1801  FTENMERNCR APCNIQMEDP TFKENYRFHA INGYIMDTLP GLVMAQDQRI

1851  RWYLLSMGSN ENIHSIHFSG HVFTVRKKEE YKMALYNLYP GVFETVEMLP

1901  SKAGIWRVEC LIGEHLHAGM STLFLVYSNK CQTPLGMASG HIRDFQITAS

1951  GQYGQWAPKL ARLHYSGSIN AWSTKEPFSW IKVDLLAPMI IHGIKTQGAR

2001  QKFSSLYISQ FIIMYSLDGK KWQTYRGNST GTLMVFFGNV DSSGIKHNIF

2051  NPPIIARYIR LHPTHYSIRS TLRMELMGCD LNSCSMPLGM ESKAISDAQI

2101  TASSYFTNMF ATWSPSKARL HLQGRSNAWR PQVNNPKEWL QVDFQKTMKV

2151  TGVTTQGVKS LLTSMYVKEF LISSSQDGHQ WTLFFQNGKV KVFQGNQDSF

2201  TPVVNSLDPP LLTRYLRIHP QSWVHQIALR MEVLGCEAQD LY
``` pSYN FVIII 310 Nucleotide Sequence (Encoding FVIII with Complete B-Domain Deletion Except 2 Amino Acid Residues and 288 AE-XTEN Inserted after aa 742) (SEQ ID NO:170)

1 ATGCAAATAG AGCTCTCCAC CTGCTTCTTT CTGTGCCTTT TGCGATTCTG

51 CTTTAGTGCC ACCAGAAGAT ACTACCTGGG TGCAGTGGAA CTGTCATGGG

101 ACTATATGCA AAGTGATCTC GGTGAGCTGC CTGTGGACGC AAGATTTCCT

151 CCTAGAGTGC CAAAATCTTT TCCATTCAAC ACCTCAGTCG TGTACAAAAA

```
 201 GACTCTGTTT GTAGAATTCA CGGATCACCT TTTCAACATC GCTAAGCCAA
 251 GGCCACCCTG GATGGGTCTG CTAGGTCCTA CCATCCAGGC TGAGGTTTAT
 301 GATACAGTGG TCATTACACT TAAGAACATG GCTTCCCATC CTGTCAGTCT
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
 601 GGGAGTCTGG CCAAGGAAAA GACACAGACC TTGCACAAAT TTATACTACT
 651 TTTTGCTGTA TTTGATGAAG GGAAAAGTTG GCACTCAGAA ACAAAGAACT
 701 CCTTGATGCA GGATAGGGAT GCTGCATCTG CTCGGGCCTG GCCTAAAATG
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTCAAAC
 951 ACTCTTGATG GACCTTGGAC AGTTTCTACT GTTTTGTCAT ATCTCTTCCC
1001 ACCAACATGA TGGCATGGAA GCTTATGTCA AAGTAGACAG CTGTCCAGAG
1051 GAACCCCAAC TACGAATGAA AAATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AGTCAATAT TTGAACAATG
1301 GCCCTCAGCG GATTGGTAGG AAGTACAAAA AAGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA AGAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCG
2101 ATGGAAAACC CAGGTCTATG GATTCTGGGG TGCCACAACT CAGACTTTCG
2151 GAACAGAGGC ATGACCGCCT TACTGAAGGT TTCTAGTTGT GACAAGAACA
2201 CTGGTGATTA TTACGAGGAC AGTTATGAAG ATATTTCAGC ATACTTGCTG
```

-continued

```
2251 AGTAAAAACA ATGCCATTGA ACCAAGAAGC TTCGGTACCT CAGAGTCTGC
2301 TACCCCCGAG TCAGGGCCAG GATCAGAGCC AGCCACCTCC GGGTCTGAGA
2351 CACCCGGGAC TTCCGAGAGT GCCACCCCTG AGTCCGGACC CGGGTCCGAG
2401 CCCGCCACTT CCGGCTCCGA AACTCCCGGC ACAAGCGAGA GCGCTACCCC
2451 AGAGTCAGGA CCAGGAACAT CTACAGAGCC CTCTGAAGGC TCCGCTCCAG
2501 GGTCCCCAGC CGGCAGTCCC ACTAGCACCG AGGAGGGAAC CTCTGAAAGC
2551 GCCACACCCG AATCAGGGCC AGGGTCTGAG CCTGCTACCA GCGGCAGCGA
2601 GACACCAGGC ACCTCTGAGT CCGCCACACC AGAGTCCGGA CCCGGATCTC
2651 CCGCTGGGAG CCCCACCTCC ACTGAGGAGG GATCTCCTGC TGGCTCTCCA
2701 ACATCTACTG AGGAAGGTAC CTCAACCGAG CCATCCGAGG GATCAGCTCC
2751 CGGCACCTCA GAGTCGGCAA CCCCGGAGTC TGGACCCGGA ACTTCCGAAA
2801 GTGCCACACC AGAGTCCGGT CCCGGGACTT CAGAATCAGC AACACCCGAG
2851 TCCGGCCCTG GGTCTGAACC CGCCACAAGT GGTAGTGAGA CACCAGGATC
2901 AGAACCTGCT ACCTCAGGGT CAGAGACACC CGGATCTCCG GCAGGCTCAC
2951 CAACCTCCAC TGAGGAGGGC ACCAGCACAG AACCAAGCGA GGGCTCCGCA
3001 CCCGGAACAA GCACTGAACC CAGTGAGGGT TCAGCACCCG GCTCTGAGCC
3051 GGCCACAAGT GGCAGTGAGA CACCCGGCAC TTCAGAGAGT GCCACCCCCG
3101 AGAGTGGCCC AGGCACTAGT ACCGAGCCCT CTGAAGGCAG TGCGCCAGCC
3151 TCGAGCGAAA TAACTCGTAC TACTCTTCAG TCAGATCAAG AGGAAATCGA
3201 TTATGATGAT ACCATATCAG TTGAAATGAA GAAGGAAGAT TTTGACATTT
3251 ATGATGAGGA TGAAAATCAG AGCCCCCGCA GCTTTCAAAA GAAAACACGA
3301 CACTATTTTA TTGCTGCAGT GGAGAGGCTC TGGGATTATG GGATGAGTAG
3351 CTCCCCACAT GTTCTAAGAA ACAGGGCTCA GAGTGGCAGT GTCCCTCAGT
3401 TCAAGAAAGT TGTTTTCCAG GAATTTACTG ATGGCTCCTT TACTCAGCCC
3451 TTATACCGTG GAGAACTAAA TGAACATTTG GGACTCCTGG GGCCATATAT
3501 AAGAGCAGAA GTTGAAGATA ATATCATGGT AACTTTCAGA AATCAGGCCT
3551 CTCGTCCCTA TTCCTTCTAT TCTAGCCTTA TTTCTTATGA GGAAGATCAG
3601 AGGCAAGGAG CAGAACCTAG AAAAAACTTT GTCAAGCCTA ATGAAACCAA
3651 AACTTACTTT TGGAAAGTGC AACATCATAT GGCACCCACT AAAGATGAGT
3701 TTGACTGCAA AGCCTGGGCT TATTTCTCTG ATGTTGACCT GGAAAAAGAT
3751 GTGCACTCAG GCCTGATTGG ACCCCTTCTG GTCTGCCACA CTAACACACT
3801 GAACCCTGCT CATGGGAGAC AAGTGACAGT ACAGGAATTT GCTCTGTTTT
3851 TCACCATCTT TGATGAGACC AAAAGCTGGT ACTTCACTGA AAATATGGAA
3901 AGAAACTGCA GGGCTCCCTG CAATATCCAG ATGGAAGATC CCACTTTTAA
3951 AGAGAATTAT CGCTTCCATG CAATCAATGG CTACATAATG GATACACTAC
4001 CTGGCTTAGT AATGGCTCAG GATCAAAGGA TTCGATGGTA TCTGCTCAGC
4051 ATGGGCAGCA ATGAAAACAT CCATTCTATT CATTTCAGTG GACATGTGTT
4101 CACTGTACGA AAAAAAGAGG AGTATAAAAT GGCACTGTAC AATCTCTATC
4151 CAGGTGTTTT TGAGACAGTG GAAATGTTAC CATCCAAAGC TGGAATTTGG
4201 CGGGTGGAAT GCCTTATTGG CGAGCATCTA CATGCTGGGA TGAGCACACT
```

```
4251 TTTTCTGGTG TACAGCAATA AGTGTCAGAC TCCCCTGGGA ATGGCTTCTG

4301 GACACATTAG AGATTTTCAG ATTACAGCTT CAGGACAATA TGGACAGTGG

4351 GCCCCAAAGC TGGCCAGACT TCATTATTCC GGATCAATCA ATGCCTGGAG

4401 CACCAAGGAG CCCTTTTCTT GGATCAAGGT GGATCTGTTG CACCAATGA

4451 TTATTCACGG CATCAAGACC CAGGGTGCCC GTCAGAAGTT CTCCAGCCTC

4501 TACATCTCTC AGTTTATCAT CATGTATAGT CTTGATGGGA AGAAGTGGCA

4551 GACTTATCGA GGAAATTCCA CTGGAACCTT AATGGTCTTC TTTGGCAATG

4601 TGGATTCATC TGGGATAAAA CACAATATTT TTAACCCTCC AATTATTGCT

4651 CGATACATCC GTTTGCACCC AACTCATTAT AGCATTCGCA GCACTCTTCG

4701 CATGGAGTTG ATGGGCTGTG ATTTAAATAG TTGCAGCATG CCATTGGGAA

4751 TGGAGAGTAA AGCAATATCA GATGCACAGA TTACTGCTTC ATCCTACTTT

4801 ACCAATATGT TTGCCACCTG GTCTCCTTCA AAAGCTCGAC TTCACCTCCA

4851 AGGGAGGAGT AATGCCTGGA GACCTCAGGT GAATAATCCA AAAGAGTGGC

4901 TGCAAGTGGA CTTCCAGAAG ACAATGAAAG TCACAGGAGT AACTACTCAG

4951 GGAGTAAAAT CTCTGCTTAC CAGCATGTAT GTGAAGGAGT TCCTCATCTC

5001 CAGCAGTCAA GATGGCCATC AGTGGACTCT CTTTTTTCAG AATGGCAAAG

5051 TAAAGGTTTT TCAGGGAAAT CAAGACTCCT TCACACCTGT GGTGAACTCT

5101 CTAGACCCAC CGTTACTGAC TCGCTACCTT CGAATTCACC CCCAGAGTTG

5151 GGTGCACCAG ATTGCCCTGA GGATGGAGGT TCTGGGCTGC GAGGCACAGG

5201 ACCTCTACGA CAAAACTCAC ACATGCCCAC CGTGCCCAGC TCCAGAACTC

5251 CTGGGCGGAC CGTCAGTCTT CCTCTTCCCC CCAAAACCCA AGGACACCCT

5301 CATGATCTCC CGGACCCCTG AGGTCACATG CGTGGTGGTG GACGTGAGCC

5351 ACGAAGACCC TGAGGTCAAG TTCAACTGGT ACGTGGACGG CGTGGAGGTG

5401 CATAATGCCA AGACAAAGCC GCGGGAGGAG CAGTACAACA GCACGTACCG

5451 TGTGGTCAGC GTCCTCACCG TCCTGCACCA GGACTGGCTG AATGGCAAGG

5501 AGTACAAGTG CAAGGTCTCC AACAAAGCCC TCCCAGCCCC CATCGAGAAA

5551 ACCATCTCCA AAGCCAAAGG GCAGCCCCGA GAACCACAGG TGTACACCCT

5601 GCCCCCATCC CGGGATGAGC TGACCAAGAA CCAGGTCAGC CTGACCTGCC

5651 TGGTCAAAGG CTTCTATCCC AGCGACATCG CCGTGGAGTG GGAGAGCAAT

5701 GGGCAGCCGG AGAACAACTA CAAGACCACG CCTCCCGTGT GGACTCCGA

5751 CGGCTCCTTC TTCCTCTACA GCAAGCTCAC CGTGGACAAG AGCAGGTGGC

5801 AGCAGGGGAA CGTCTTCTCA TGCTCCGTGA TGCATGAGGC TCTGCACAAC

5851 CACTACACGC AGAAGAGCCT CTCCCTGTCT CCGGGTAAAT GA
``` pSYN FVIII 310 Protein Sequence (FVIII with Complete B-Domain Deletion Except 2 Amino Acid Residues and 288 AE-XTEN Inserted after aa 742) (SEQ ID NO:171)

```
  1  ATRRYYLGAV ELSWDYMQSD LGELPVDARF PPRVPKSFPF NTSVVYKKTL

51  FVEFTDHLFN IAKPRPPWMG LLGPTIQAEV YDTVVITLKN MASHPVSLHA

101  VGVSYWKASE GAEYDDQTSQ REKEDDKVFP GGSHTYVWQV LKENGPMASD

151  PLCLTYSYLS HVDLVKDLNS GLIGALLVCR EGSLAKEKTQ TLHKFILLFA
```

-continued

```
 201 VFDEGKSWHS ETKNSLMQDR DAASARAWPK MHTVNGYVNR SLPGLIGCHR
 251 KSVYWHVIGM GTTPEVHSIF LEGHTFLVRN HRQASLEISP ITFLTAQTLL
 301 MDLGQFLLFC HISSHQHDGM EAYVKVDSCP EEPQLRMKNN EEAEDYDDDL
 351 TDSEMDVVRF DDDNSPSFIQ IRSVAKKHPK TWVHYIAAEE EDWDYAPLVL
 401 APDDRSYKSQ YLNNGPQRIG RKYKKVRFMA YTDETFKTRE AIQHESGILG
 451 PLLYGEVGDT LLIIFKNQAS RPYNIYPHGI TDVRPLYSRR LPKGVKHLKD
 501 FPILPGEIFK YKWTVTVEDG PTKSDPRCLT RYYSSFVNME RDLASGLIGP
 551 LLICYKESVD QRGNQIMSDK RNVILFSVFD ENRSWYLTEN IQRFLPNPAG
 601 VQLEDPEFQA SNIMHSINGY VFDSLQLSVC LHEVAYWYIL SIGAQTDFLS
 651 VFFSGYTFKH KMVYEDTLTL FPFSGETVFM SMENPGLWIL GCHNSDFRNR
 701 GMTALLKVSS CDKNTGDYYE DSYEDISAYL LSKNNAIEPR SFGTSESATP
 751 ESGPGSEPAT SGSETPGTSE SATPESGPGS EPATSGSETP GTSESATPES
 801 GPGTSTEPSE GSAPGSPAGS PTSTEEGTSE SATPESGPGS EPATSGSETP
 851 GTSESATPES GPGSPAGSPT STEEGSPAGS PTSTEEGTST EPSEGSAPGT
 901 SESATPESGP GTSESATPES GPGTSESATP ESGPGSEPAT SGSETPGSEP
 951 ATSGSETPGS PAGSPTSTEE GTSTEPSEGS APGTSTEPSE GSAPGSEPAT
1001 SGSETPGTSE SATPESGPGT STEPSEGSAP ASSEITRTTL QSDQEEIDYD
1051 DTISVEMKKE DFDIYDEDEN QSPRSFQKKT RHYFIAAVER LWDYGMSSSP
1101 HVLRNRAQSG SVPQFKKVVF QEFTDGSFTQ PLYRGELNEH LGLLGPYIRA
1151 EVEDNIMVTF RNQASRPYSF YSSLISYEED QRQGAEPRKN FVKPNETKTY
1201 FWKVQHHMAP TKDEFDCKAW AYFSDVDLEK DVHSGLIGPL LVCHTNTLNP
1251 AHGRQVTVQE FALFFTIFDE TKSWYFTENM ERNCRAPCNI QMEDPTFKEN
1301 YRFHAINGYI MDTLPGLVMA QDQRIRWYLL SMGSNENIHS IHFSGHVFTV
1351 RKKEEYKMAL YNLYPGVFET VEMLPSKAGI WRVECLIGEH LHAGMSTLFL
1401 VYSNKCQTPL GMASGHIRDF QITASGQYGQ WAPKLARLHY SGSINAWSTK
1451 EPFSWIKVDL LAPMIIHGIK TQGARQKFSS LYISQFIIMY SLDGKKWQTY
1501 RGNSTGTLMV FFGNVDSSGI KHNIFNPPII ARYIRLHPTH YSIRSTLRME
1551 LMGCDLNSCS MPLGMESKAI SDAQITASSY FTNMFATWSP SKARLHLQGR
1601 SNAWRPQVNN PKEWLQVDFQ KTMKVTGVTT QGVKSLLTSM YVKEFLISSS
1651 QDGHQWTLFF QNGKVKVFQG NQDSFTPVVN SLDPPLLTRY LRIHPQSWVH
1701 QIALRMEVLG CEAQDLYDKT HTCPPCPAPE LLGGPSVFLF PPKPKDTLMI
1751 SRTPEVTCVV VDVSHEDPEV KFNWYVDGVE VHNAKTKPRE EQYNSTYRVV
1801 SVLTVLHQDW LNGKEYKCKV SNKALPAPIE KTISKAKGQP REPQVYTLPP
1851 SRDELTKNQV SLTCLVKGFY PSDIAVEWES NGQPENNYKT TPPVLDSDGS
1901 FFLYSKLTVD KSRWQQGNVF SCSVMHEALH NHYTQKSLSL SPGK*
``` pSYN FVIII 312 Nucleotide Sequence (Encoding FVIII with Complete B-Domain Deletion Except 5 Amino Acid Residues and 288 AE-XTEN Inserted after aa 745-B5 Version) (SEQ ID NO:172)

```
 1 ATGCAAATAG AGCTCTCCAC CTGCTTCTTT CTGTGCCTTT TGCGATTCTG
51 CTTTAGTGCC ACCAGAAGAT ACTACCTGGG TGCAGTGGAA CTGTCATGGG
```

-continued

```
 101 ACTATATGCA AAGTGATCTC GGTGAGCTGC CTGTGGACGC AAGATTTCCT
 151 CCTAGAGTGC CAAAATCTTT TCCATTCAAC ACCTCAGTCG TGTACAAAAA
 201 GACTCTGTTT GTAGAATTCA CGGATCACCT TTTCAACATC GCTAAGCCAA
 251 GGCCACCCTG GATGGGTCTG CTAGGTCCTA CCATCCAGGC TGAGGTTTAT
 301 GATACAGTGG TCATTACACT TAAGAACATG GCTTCCCATC CTGTCAGTCT
 351 TCATGCTGTT GGTGTATCCT ACTGGAAAGC TTCTGAGGGA GCTGAATATG
 401 ATGATCAGAC CAGTCAAAGG GAGAAAGAAG ATGATAAAGT CTTCCCTGGT
 451 GGAAGCCATA CATATGTCTG GCAGGTCCTG AAAGAGAATG GTCCAATGGC
 501 CTCTGACCCA CTGTGCCTTA CCTACTCATA TCTTTCTCAT GTGGACCTGG
 551 TAAAAGACTT GAATTCAGGC CTCATTGGAG CCCTACTAGT ATGTAGAGAA
 601 GGGAGTCTGG CCAAGGAAAA GACACAGACC TTGCACAAAT TTATACTACT
 651 TTTTGCTGTA TTTGATGAAG GGAAAAGTTG GCACTCAGAA ACAAAGAACT
 701 CCTTGATGCA GGATAGGGAT GCTGCATCTG CTCGGGCCTG GCCTAAAATG
 751 CACACAGTCA ATGGTTATGT AAACAGGTCT CTGCCAGGTC TGATTGGATG
 801 CCACAGGAAA TCAGTCTATT GGCATGTGAT TGGAATGGGC ACCACTCCTG
 851 AAGTGCACTC AATATTCCTC GAAGGTCACA CATTTCTTGT GAGGAACCAT
 901 CGCCAGGCGT CCTTGGAAAT CTCGCCAATA ACTTTCCTTA CTGCTCAAAC
 951 ACTCTTGATG GACCTTGGAC AGTTTCTACT GTTTTGTCAT ATCTCTTCCC
1001 ACCAACATGA TGGCATGGAA GCTTATGTCA AGTAGACAG CTGTCCAGAG
1051 GAACCCCAAC TACGAATGAA AAATAATGAA GAAGCGGAAG ACTATGATGA
1101 TGATCTTACT GATTCTGAAA TGGATGTGGT CAGGTTTGAT GATGACAACT
1151 CTCCTTCCTT TATCCAAATT CGCTCAGTTG CCAAGAAGCA TCCTAAAACT
1201 TGGGTACATT ACATTGCTGC TGAAGAGGAG GACTGGGACT ATGCTCCCTT
1251 AGTCCTCGCC CCCGATGACA GAAGTTATAA AGTCAATAT TTGAACAATG
1301 GCCCTCAGCG GATTGGTAGG AAGTACAAAA AGTCCGATT TATGGCATAC
1351 ACAGATGAAA CCTTTAAGAC TCGTGAAGCT ATTCAGCATG AATCAGGAAT
1401 CTTGGGACCT TTACTTTATG GGGAAGTTGG AGACACACTG TTGATTATAT
1451 TTAAGAATCA AGCAAGCAGA CCATATAACA TCTACCCTCA CGGAATCACT
1501 GATGTCCGTC CTTTGTATTC AAGGAGATTA CCAAAAGGTG TAAAACATTT
1551 GAAGGATTTT CCAATTCTGC CAGGAGAAAT ATTCAAATAT AAATGGACAG
1601 TGACTGTAGA AGATGGGCCA ACTAAATCAG ATCCTCGGTG CCTGACCCGC
1651 TATTACTCTA GTTTCGTTAA TATGGAGAGA GATCTAGCTT CAGGACTCAT
1701 TGGCCCTCTC CTCATCTGCT ACAAAGAATC TGTAGATCAA AGAGGAAACC
1751 AGATAATGTC AGACAAGAGG AATGTCATCC TGTTTTCTGT ATTTGATGAG
1801 AACCGAAGCT GGTACCTCAC AGAGAATATA CAACGCTTTC TCCCCAATCC
1851 AGCTGGAGTG CAGCTTGAGG ATCCAGAGTT CCAAGCCTCC AACATCATGC
1901 ACAGCATCAA TGGCTATGTT TTTGATAGTT TGCAGTTGTC AGTTTGTTTG
1951 CATGAGGTGG CATACTGGTA CATTCTAAGC ATTGGAGCAC AGACTGACTT
2001 CCTTTCTGTC TTCTTCTCTG GATATACCTT CAAACACAAA ATGGTCTATG
2051 AAGACACACT CACCCTATTC CCATTCTCAG GAGAAACTGT CTTCATGTCG
```

```
2101 ATGGAAAACC CAGGTCTATG GATTCTGGGG TGCCACAACT CAGACTTTCG
2151 GAACAGAGGC ATGACCGCCT TACTGAAGGT TTCTAGTTGT GACAAGAACA
2201 CTGGTGATTA TTACGAGGAC AGTTATGAAG ATATTTCAGC ATACTTGCTG
2251 AGTAAAAACA ATGCCATTGA ACCAAGAAGC TTCTCTCAAA ACGGTACCTC
2301 AGAGTCTGCT ACCCCCGAGT CAGGGCCAGG ATCAGAGCCA GCCACCTCCG
2351 GGTCTGAGAC ACCCGGGACT TCCGAGAGTG CCACCCCTGA GTCCGGACCC
2401 GGGTCCGAGC CCGCCACTTC CGGCTCCGAA ACTCCCGGCA CAAGCGAGAG
2451 CGCTACCCCA GAGTCAGGAC CAGGAACATC TACAGAGCCC TCTGAAGGCT
2501 CCGCTCCAGG GTCCCCAGCC GGCAGTCCCA CTAGCACCGA GGAGGGAACC
2551 TCTGAAAGCG CCACACCCGA ATCAGGGCCA GGGTCTGAGC CTGCTACCAG
2601 CGGCAGCGAG ACACCAGGCA CCTCTGAGTC CGCCACACCA GAGTCCGGAC
2651 CCGGATCTCC CGCTGGGAGC CCCACCTCCA CTGAGGAGGG ATCTCCTGCT
2701 GGCTCTCCAA CATCTACTGA GGAAGGTACC TCAACCGAGC CATCCGAGGG
2751 ATCAGCTCCC GGCACCTCAG AGTCGGCAAC CCCGGAGTCT GGACCCGGAA
2801 CTTCCGAAAG TGCCACACCA GAGTCCGGTC CCGGGACTTC AGAATCAGCA
2851 ACACCCGAGT CCGGCCCTGG GTCTGAACCC GCCACAAGTG GTAGTGAGAC
2901 ACCAGGATCA GAACCTGCTA CCTCAGGGTC AGAGACACCC GGATCTCCGG
2951 CAGGCTCACC AACCTCCACT GAGGAGGGCA CCAGCACAGA ACCAAGCGAG
3001 GGCTCCGCAC CCGGAACAAG CACTGAACCC AGTGAGGGTT CAGCACCCGG
3051 CTCTGAGCCG GCCACAAGTG GCAGTGAGAC ACCCGGCACT TCAGAGAGTG
3101 CCACCCCCGA GAGTGGCCCA GGCACTAGTA CCGAGCCCTC TGAAGGCAGT
3151 GCGCCAGCCT CGAGCGAAAT AACTCGTACT ACTCTTCAGT CAGATCAAGA
3201 GGAAATCGAT TATGATGATA CCATATCAGT TGAAATGAAG AAGGAAGATT
3251 TTGACATTTA TGATGAGGAT GAAAATCAGA GCCCCCGCAG CTTTCAAAAG
3301 AAAACACGAC ACTATTTTAT TGCTGCAGTG GAGAGGCTCT GGGATTATGG
3351 GATGAGTAGC TCCCCACATG TTCTAAGAAA CAGGGCTCAG AGTGGCAGTG
3401 TCCCTCAGTT CAAGAAAGTT GTTTTCCAGG AATTTACTGA TGGCTCCTTT
3451 ACTCAGCCCT TATACCGTGG AGAACTAAAT GAACATTTGG GACTCCTGGG
3501 GCCATATATA AGAGCAGAAG TTGAAGATAA TATCATGGTA ACTTTCAGAA
3551 ATCAGGCCTC TCGTCCCTAT TCCTTCTATT CTAGCCTTAT TTCTTATGAG
3601 GAAGATCAGA GGCAAGGAGC AGAACCTAGA AAAACTTTG TCAAGCCTAA
3651 TGAAACCAAA ACTTACTTTT GGAAAGTGCA ACATCATATG GCACCCACTA
3701 AAGATGAGTT TGACTGCAAA GCCTGGGCTT ATTTCTCTGA TGTTGACCTG
3751 GAAAAAGATG TGCACTCAGG CCTGATTGGA CCCCTTCTGG TCTGCCACAC
3801 TAACACACTG AACCCTGCTC ATGGGAGACA AGTGACAGTA CAGGAATTTG
3851 CTCTGTTTTT CACCATCTTT GATGAGACCA AAAGCTGGTA CTTCACTGAA
3901 AATATGGAAA GAAACTGCAG GGCTCCCTGC AATATCCAGA TGGAAGATCC
3951 CACTTTTAAA GAGAATTATC GCTTCCATGC AATCAATGGC TACATAATGG
4001 ATACACTACC TGGCTTAGTA ATGGCTCAGG ATCAAAGGAT TCGATGGTAT
4051 CTGCTCAGCA TGGGCAGCAA TGAAAACATC CATTCTATTC ATTTCAGTGG
4101 ACATGTGTTC ACTGTACGAA AAAAAGAGGA GTATAAAATG GCACTGTACA
```

```
4151 ATCTCTATCC AGGTGTTTTT GAGACAGTGG AAATGTTACC ATCCAAAGCT

4201 GGAATTTGGC GGGTGGAATG CCTTATTGGC GAGCATCTAC ATGCTGGGAT

4251 GAGCACACTT TTTCTGGTGT ACAGCAATAA GTGTCAGACT CCCCTGGGAA

4301 TGGCTTCTGG ACACATTAGA GATTTTCAGA TTACAGCTTC AGGACAATAT

4351 GGACAGTGGG CCCCAAAGCT GGCCAGACTT CATTATTCCG GATCAATCAA

4401 TGCCTGGAGC ACCAAGGAGC CCTTTTCTTG GATCAAGGTG GATCTGTTGG

4451 CACCAATGAT TATTCACGGC ATCAAGACCC AGGGTGCCCG TCAGAAGTTC

4501 TCCAGCCTCT ACATCTCTCA GTTTATCATC ATGTATAGTC TTGATGGGAA

4551 GAAGTGGCAG ACTTATCGAG GAAATTCCAC TGGAACCTTA ATGGTCTTCT

4601 TTGGCAATGT GGATTCATCT GGGATAAAAC ACAATATTTT TAACCCTCCA

4651 ATTATTGCTC GATACATCCG TTTGCACCCA ACTCATTATA GCATTCGCAG

4701 CACTCTTCGC ATGGAGTTGA TGGGCTGTGA TTTAAATAGT TGCAGCATGC

4751 CATTGGGAAT GGAGAGTAAA GCAATATCAG ATGCACAGAT TACTGCTTCA

4801 TCCTACTTTA CCAATATGTT TGCCACCTGG TCTCCTTCAA AAGCTCGACT

4851 TCACCTCCAA GGGAGGAGTA ATGCCTGGAG ACCTCAGGTG AATAATCCAA

4901 AAGAGTGGCT GCAAGTGGAC TTCCAGAAGA CAATGAAAGT CACAGGAGTA

4951 ACTACTCAGG GAGTAAAATC TCTGCTTACC AGCATGTATG TGAAGGAGTT

5001 CCTCATCTCC AGCAGTCAAG ATGGCCATCA GTGGACTCTC TTTTTTCAGA

5051 ATGGCAAAGT AAAGGTTTTT CAGGGAAATC AAGACTCCTT CACACCTGTG

5101 GTGAACTCTC TAGACCCACC GTTACTGACT CGCTACCTTC GAATTCACCC

5151 CCAGAGTTGG GTGCACCAGA TTGCCCTGAG GATGGAGGTT CTGGGCTGCG

5201 AGGCACAGGA CCTCTACGAC AAAACTCACA CATGCCCACC GTGCCCAGCT

5251 CCAGAACTCC TGGGCGGACC GTCAGTCTTC CTCTTCCCCC CAAAACCCAA

5301 GGACACCCTC ATGATCTCCC GGACCCCTGA GGTCACATGC GTGGTGGTGG

5351 ACGTGAGCCA CGAAGACCCT GAGGTCAAGT TCAACTGGTA CGTGGACGGC

5401 GTGGAGGTGC ATAATGCCAA GACAAAGCCG CGGGAGGAGC AGTACAACAG

5451 CACGTACCGT GTGGTCAGCG TCCTCACCGT CCTGCACCAG GACTGGCTGA

5501 ATGGCAAGGA GTACAAGTGC AAGGTCTCCA ACAAAGCCCT CCCAGCCCCC

5551 ATCGAGAAAA CCATCTCCAA AGCCAAAGGG CAGCCCCGAG AACCACAGGT

5601 GTACACCCTG CCCCCATCCC GGGATGAGCT GACCAAGAAC CAGGTCAGCC

5651 TGACCTGCCT GGTCAAAGGC TTCTATCCCA GCGACATCGC CGTGGAGTGG

5701 GAGAGCAATG GGCAGCCGGA GAACAACTAC AAGACCACGC CTCCCGTGTT

5751 GGACTCCGAC GGCTCCTTCT TCCTCTACAG CAAGCTCACC GTGGACAAGA

5801 GCAGGTGGCA GCAGGGGAAC GTCTTCTCAT GCTCCGTGAT GCATGAGGCT

5851 CTGCACAACC ACTACACGCA GAAGAGCCTC TCCCTGTCTC CGGGTAAATG
``` pSYN FVIII 312 Protein Sequence (FVIII with Complete B-Domain Deletion Except 5 Amino Acid Residues and 288 AE-XTEN Inserted after aa 745-B5 Version) (SEQ ID NO:173)

```
   1 ATRRYYLGAV ELSWDYMQSD LGELPVDARF PPRVPKSFPF NTSVVYKKTL
  51 FVEFTDHLFN IAKPRPPWMG LLGPTIQAEV YDTVVITLKN MASHPVSLHA
 101 VGVSYWKASE GAEYDDQTSQ REKEDDKVFP GGSHTYVWQV LKENGPMASD
 151 PLCLTYSYLS HVDLVKDLNS GLIGALLVCR EGSLAKEKTQ TLHKFILLFA
 201 VFDEGKSWHS ETKNSLMQDR DAASARAWPK MHTVNGYVNR SLPGLIGCHR
 251 KSVYWHVIGM GTTPEVHSIF LEGHTFLVRN HRQASLEISP ITFLTAQTLL
 301 MDLGQFLLFC HISSHQHDGM EAYVKVDSCP EEPQLRMKNN EEAEDYDDDL
 351 TDSEMDVVRF DDDNSPSFIQ IRSVAKKHPK TWVHYIAAEE EDWDYAPLVL
 401 APDDRSYKSQ YLNNGPQRIG RKYKKVRFMA YTDETFKTRE AIQHESGILG
 451 PLLYGEVGDT LLIIFKNQAS RPYNIYPHGI TDVRPLYSRR LPKGVKHLKD
 501 FPILPGEIFK YKWTVTVEDG PTKSDPRCLT RYYSSFVNME RDLASGLIGP
 551 LLICYKESVD QRGNQIMSDK RNVILFSVFD ENRSWYLTEN IQRFLPNPAG
 601 VQLEDPEFQA SNIMHSINGY VFDSLQLSVC LHEVAYWYIL SIGAQTDFLS
 651 VFFSGYTFKH KMVYEDTLTL FPFSGETVFM SMENPGLWIL GCHNSDFRNR
 701 GMTALLKVSS CDKNTGDYYE DSYEDISAYL LSKNNAIEPR SFSQNGTSES
 751 ATPESGPGSE PATSGSETPG TSESATPESG PGSEPATSGS ETPGTSESAT
 801 PESGPGTSTE PSEGSAPGSP AGSPTSTEEG TSESATPESG PGSEPATSGS
 851 ETPGTSESAT PESGPGSPAG SPTSTEEGSP AGSPTSTEEG TSTEPSEGSA
 901 PGTSESATPE SGPGTSESAT PESGPGTSES ATPESGPGSE PATSGSETPG
 951 SEPATSGSET PGSPAGSPTS TEEGTSTEPS EGSAPGTSTE PSEGSAPGSE
1001 PATSGSETPG TSESATPESG PGTSTEPSEG SAPASSEITR TTLQSDQEEI
1051 DYDDTISVEM KKEDFDIYDE DENQSPRSFQ KKTRHYFIAA VERLWDYGMS
1101 SSPHVLRNRA QSGSVPQFKK VVFQEFTDGS FTQPLYRGEL NEHLGLLGPY
1151 IRAEVEDNIM VTFRNQASRP YSFYSSLISY EEDQRQGAEP RKNFVKPNET
1201 KTYFWKVQHH MAPTKDEFDC KAWAYFSDVD LEKDVHSGLI GPLLVCHTNT
1251 LNPAHGRQVT VQEFALFFTI FDETKSWYFT ENMERNCRAP CNIQMEDPTF
1301 KENYRFHAIN GYIMDTLPGL VMAQDQRIRW YLLSMGSNEN IHSIHFSGHV
1351 FTVRKKEEYK MALYNLYPGV FETVEMLPSK AGIWRVECLI GEHLHAGMST
1401 LFLVYSNKCQ TPLGMASGHI RDFQITASGQ YGQWAPKLAR LHYSGSINAW
1451 STKEPFSWIK VDLLAPMIIH GIKTQGARQK FSSLYISQFI IMYSLDGKKW
1501 QTYRGNSTGT LMVFFGNVDS SGIKHNIFNP PIIARYIRLH PTHYSIRSTL
1551 RMELMGCDLN SCSMPLGMES KAISDAQITA SSYFTNMFAT WSPSKARLHL
1601 QGRSNAWRPQ VNNPKEWLQV DFQKTMKVTG VTTQGVKSLL TSMYVKEFLI
1651 SSSQDGHQWT LFFQNGKVKV FQGNQDSFTP VVNSLDPPLL TRYLRIHPQS
1701 WVHQIALRME VLGCEAQDLY DKTHTCPPCP APELLGGPSV FLFPPKPKDT
1751 LMISRTPEVT CVVVDVSHED PEVKFNWYVD GVEVHNAKTK PREEQYNSTY
1801 RVVSVLTVLH QDWLNGKEYK CKVSNKALPA PIEKTISKAK GQPREPQVYT
```

```
1851 LPPSRDELTK NQVSLTCLVK GFYPSDIAVE WESNGQPENN YKTTPPVLDS

1901 DGSFFLYSKL TVDKSRWQQG NVFSCSVMHE ALHNHYTQKS LSLSPGK*
``` pSYN VWF059 Nucleotide Sequence (Encoding VWF D'D3-Fc with Acidic Region 2 (a2) Thrombin Site in the Linker) (SEQ ID NO: 196)

```
   1 ATGATTCCTG CCAGATTTGC CGGGGTGCTG CTTGCTCTGG CCCTCATTTT

51 GCCAGGGACC CTTTGTGCAG AAGGAACTCG CGGCAGGTCA TCCACGGCCC

101 GATGCAGCCT TTTCGGAAGT GACTTCGTCA ACACCTTTGA TGGGAGCATG

151 TACAGCTTTG CGGGATACTG CAGTTACCTC CTGGCAGGGG GCTGCCAGAA

201 ACGCTCCTTC TCGATTATTG GGACTTCCA GAATGGCAAG AGAGTGAGCC

251 TCTCCGTGTA TCTTGGGGAA TTTTTTGACA TCCATTTGTT TGTCAATGGT

301 ACCGTGACAC AGGGGGACCA AAGAGTCTCC ATGCCCTATG CCTCCAAAGG

351 GCTGTATCTA GAAACTGAGG CTGGGTACTA CAAGCTGTCC GGTGAGGCCT

401 ATGGCTTTGT GGCCAGGATC GATGGCAGCG GCAACTTTCA AGTCCTGCTG

451 TCAGACAGAT ACTTCAACAA GACCTGCGGG CTGTGTGGCA ACTTTAACAT

501 CTTTGCTGAA GATGACTTTA TGACCCAAGA AGGGACCTTG ACCTCGGACC

551 CTTATGACTT TGCCAACTCA TGGGCTCTGA GCAGTGGAGA ACAGTGGTGT

601 GAACGGGCAT CTCCTCCCAG CAGCTCATGC AACATCTCCT CTGGGGAAAT

651 GCAGAAGGGC CTGTGGGAGC AGTGCCAGCT TCTGAAGAGC ACCTCGGTGT

701 TTGCCCGCTG CCACCCTCTG GTGGACCCCG AGCCTTTTGT GGCCCTGTGT

751 GAGAAGACTT TGTGTGAGTG TGCTGGGGGG CTGGAGTGCG CCTGCCCTGC

801 CCTCCTGGAG TACGCCCGGA CCTGTGCCCA GGAGGGAATG GTGCTGTACG

851 GCTGGACCGA CCACAGCGCG TGCAGCCCAG TGTGCCCTGC TGGTATGGAG

901 TATAGGCAGT GTGTGTCCCC TTGCGCCAGG ACCTGCCAGA GCCTGCACAT

951 CAATGAAATG TGTCAGGAGC GATGCGTGGA TGGCTGCAGC TGCCCTGAGG

1001 GACAGCTCCT GGATGAAGGC CTCTGCGTGG AGAGCACCGA GTGTCCCTGC

1051 GTGCATTCCG GAAAGCGCTA CCCTCCCGGC ACCTCCCTCT CTCGAGACTG

1101 CAACACCTGC ATTTGCCGAA ACAGCCAGTG GATCTGCAGC AATGAAGAAT

1151 GTCCAGGGGA GTGCCTTGTC ACTGGTCAAT CCCACTTCAA GAGCTTTGAC

1201 AACAGATACT TCACCTTCAG TGGGATCTGC CAGTACCTGC TGGCCCGGGA

1251 TTGCCAGGAC CACTCCTTCT CCATTGTCAT TGAGACTGTC CAGTGTGCTG

1301 ATGACCGCGA CGCTGTGTGC ACCCGCTCCG TCACCGTCCG GCTGCCTGGC

1351 CTGCACAACA GCCTTGTGAA ACTGAAGCAT GGGGCAGGAG TTGCCATGGA

1401 TGGCCAGGAC ATCCAGCTCC CCCTCCTGAA AGGTGACCTC CGCATCCAGC

1451 ATACAGTGAC GGCCTCCGTG CGCCTCAGCT ACGGGGAGGA CCTGCAGATG

1501 GACTGGGATG GCCGCGGGAG GCTGCTGGTG AAGCTGTCCC CCGTCTATGC

1551 CGGGAAGACC TGCGGCCTGT GTGGGAATTA CAATGGCAAC CAGGGCGACG

1601 ACTTCCTTAC CCCCTCTGGG CTGGCGGAGC CCCGGGTGGA GGACTTCGGG

1651 AACGCCTGGA AGCTGCACGG GGACTGCCAG GACCTGCAGA AGCAGCACAG

1701 CGATCCCTGC GCCCTCAACC CGCGCATGAC CAGGTTCTCC GAGGAGGCGT
```

-continued

```
1751 GCGCGGTCCT GACGTCCCCC ACATTCGAGG CCTGCCATCG TGCCGTCAGC
1801 CCGCTGCCCT ACCTGCGGAA CTGCCGCTAC GACGTGTGCT CCTGCTCGGA
1851 CGGCCGCGAG TGCCTGTGCG GCGCCCTGGC CAGCTATGCC GCGGCCTGCG
1901 CGGGGAGAGG CGTGCGCGTC GCGTGGCGCG AGCCAGGCCG CTGTGAGCTG
1951 AACTGCCCGA AAGGCCAGGT GTACCTGCAG TGCGGGACCC CCTGCAACCT
2001 GACCTGCCGC TCTCTCTCTT ACCCGGATGA GGAATGCAAT GAGGCCTGCC
2051 TGGAGGGCTG CTTCTGCCCC CCAGGGCTCT ACATGGATGA GAGGGGGGAC
2101 TGCGTGCCCA AGGCCCAGTG CCCCTGTTAC TATGACGGTG AGATCTTCCA
2151 GCCAGAAGAC ATCTTCTCAG ACCATCACAC CATGTGCTAC TGTGAGGATG
2201 GCTTCATGCA CTGTACCATG AGTGGAGTCC CCGGAAGCTT GCTGCCTGAC
2251 GCTGTCCTCA GCAGTCCCCT GTCTCATCGC AGCAAAAGGA GCCTATCCTG
2301 TCGGCCCCCC ATGGTCAAGC TGGTGTGTCC CGCTGACAAC CTGCGGGCTG
2351 AAGGGCTCGA GTGTACCAAA ACGTGCCAGA ACTATGACCT GGAGTGCATG
2401 AGCATGGGCT GTGTCTCTGG CTGCCTCTGC CCCCCGGGCA TGGTCCGGCA
2451 TGAGAACAGA TGTGTGGCCC TGGAAAGGTG TCCCTGCTTC CATCAGGGCA
2501 AGGAGTATGC CCCTGGAGAA ACAGTGAAGA TTGGCTGCAA CACTTGTGTC
2551 TGTCGGGACC GGAAGTGGAA CTGCACAGAC CATGTGTGTG ATGCCACGTG
2601 CTCCACGATC GGCATGGCCC ACTACCTCAC CTTCGACGGG CTCAAATACC
2651 TGTTCCCCGG GGAGTGCCAG TACGTTCTGG TGCAGGATTA CTGCGGCAGT
2701 AACCCTGGGA CCTTTCGGAT CCTAGTGGGG AATAAGGGAT GCAGCCACCC
2751 CTCAGTGAAA TGCAAGAAAC GGGTCACCAT CCTGGTGGAG GGAGGAGAGA
2801 TTGAGCTGTT TGACGGGGAG GTGAATGTGA AGAGGCCCAT GAAGGATGAG
2851 ACTCACTTTG AGGTGGTGGA GTCTGGCCGG TACATCATTC TGCTGCTGGG
2901 CAAAGCCCTC TCCGTGGTCT GGGACCGCCA CCTGAGCATC TCCGTGGTCC
2951 TGAAGCAGAC ATACCAGGAG AAAGTGTGTG GCCTGTGTGG GAATTTTGAT
3001 GGCATCCAGA ACAATGACCT CACCAGCAGC AACCTCCAAG TGGAGGAAGA
3051 CCCTGTGGAC TTTGGGAACT CCTGGAAAGT GAGCTCGCAG TGTGCTGACA
3101 CCAGAAAAGT GCCTCTGGAC TCATCCCCTG CCACCTGCCA TAACAACATC
3151 ATGAAGCAGA CGATGGTGGA TTCCTCCTGT AGAATCCTTA CCAGTGACGT
3201 CTTCCAGGAC TGCAACAAGC TGGTGGACCC CGAGCCATAT CTGGATGTCT
3251 GCATTTACGA CACCTGCTCC TGTGAGTCCA TTGGGGACTG CGCCGCATTC
3301 TGCGACACCA TTGCTGCCTA TGCCCACGTG TGTGCCCAGC ATGGCAAGGT
3351 GGTGACCTGG AGGACGGCCA CATTGTGCCC CCAGAGCTGC GAGGAGAGGA
3401 ATCTCCGGGA GAACGGGTAT GAGGCTGAGT GGCGCTATAA CAGCTGTGCA
3451 CCTGCCTGTC AAGTCACGTG TCAGCACCCT GAGCCACTGG CCTGCCCTGT
3501 GCAGTGTGTG GAGGGCTGCC ATGCCCACTG CCCTCCAGGG AAAATCCTGG
3551 ATGAGCTTTT GCAGACCTGC GTTGACCCTG AAGACTGTCC AGTGTGTGAG
3601 GTGGCTGGCC GGCGTTTTGC CTCAGGAAAG AAAGTCACCT TGAATCCCAG
3651 TGACCCTGAG CACTGCCAGA TTTGCCACTG TGATGTTGTC AACCTCACCT
3701 GTGAAGCCTG CCAGGAGCCG ATATCGGGCG CGCCAACATC AGAGAGCGCC
```

```
3751 ACCCCTGAAA GTGGTCCCGG GAGCGAGCCA GCCACATCTG GTCGGAAAC

3801 GCCAGGCACA AGTGAGTCTG CAACTCCCGA GTCCGGACCT GGCTCCGAGC

3851 CTGCCACTAG CGGCTCCGAG ACTCCGGGAA CTTCCGAGAG CGCTACACCA

3901 GAAAGCGGAC CCGGAACCAG TACCGAACCT AGCGAGGGCT CTGCTCCGGG

3951 CAGCCCAGCC GGCTCTCCTA CATCCACGGA GGAGGGCACT TCCGAATCCG

4001 CCACCCCGGA GTCAGGGCCA GGATCTGAAC CCGCTACCTC AGGCAGTGAG

4051 ACGCCAGGAA CGAGCGAGTC CGCTACACCG GAGAGTGGGC CAGGGAGCCC

4101 TGCTGGATCT CCTACGTCCA CTGAGGAAGG GTCACCAGCG GGCTCGCCCA

4151 CCAGCACTGA AGAAGGTGCC TCGATATCTG ACAAGAACAC TGGTGATTAT

4201 TACGAGGACA GTTATGAAGA TATTTCAGCA TACTTGCTGA GTAAAAACAA

4251 TGCCATTGAA CCAAGAAGCT TCTCTGACAA AACTCACACA TGCCCACCGT

4301 GCCCAGCTCC AGAACTCCTG GGCGGACCGT CAGTCTTCCT CTTCCCCCCA

4351 AAACCCAAGG ACACCCTCAT GATCTCCCGG ACCCCTGAGG TCACATGCGT

4401 GGTGGTGGAC GTGAGCCACG AAGACCCTGA GGTCAAGTTC AACTGGTACG

4451 TGGACGGCGT GGAGGTGCAT AATGCCAAGA CAAAGCCGCG GGAGGAGCAG

4501 TACAACAGCA CGTACCGTGT GGTCAGCGTC CTCACCGTCC TGCACCAGGA

4551 CTGGCTGAAT GGCAAGGAGT ACAAGTGCAA GGTCTCCAAC AAAGCCCTCC

4601 CAGCCCCCAT CGAGAAAACC ATCTCCAAAG CCAAAGGGCA GCCCCGAGAA

4651 CCACAGGTGT ACACCCTGCC CCCATCCCGG GATGAGCTGA CCAAGAACCA

4701 GGTCAGCCTG ACCTGCCTGG TCAAAGGCTT CTATCCCAGC GACATCGCCG

4751 TGGAGTGGGA GAGCAATGGG CAGCCGGAGA ACAACTACAA GACCACGCCT

4801 CCCGTGTTGG ACTCCGACGG CTCCTTCTTC CTCTACAGCA AGCTCACCGT

4851 GGACAAGAGC AGGTGGCAGC AGGGGAACGT CTTCTCATGC TCCGTGATGC

4901 ATGAGGCTCT GCACAACCAC TACACGCAGA AGAGCCTCTC CCTGTCTCCG

4951 GGTAAATGA
``` pSYN VWF059 Protein Sequence (VWF D'D3-Fc with a2 Region of FVIII Thrombin Site in the Linker)—Bold Underlined Area Shows a2 Region (SEQ ID NO: 197)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL ETEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
451 LHNSLVKLKH GAGVAMDGQD IQLPLLKGDL RIQHTVTASV RLSYGEDLQM
501 DWDGRGRLLV KLSPVYAGKT CGLCGNYNGN QGDDFLTPSG LAEPRVEDFG
551 NAWKLHGDCQ DLQKQHSDPC ALNPRMTRFS EEACAVLTSP TFEACHRAVS
```

-continued

```
 601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGAPTSESA

1251 TPESGPGSEP ATSGSETPGT SESATPESGP GSEPATSGSE TPGTSESATP

1301 ESGPGTSTEP SEGSAPGSPA GSPTSTEEGT SESATPESGP GSEPATSGSE

1351 TPGTSESATP ESGPGSPAGS PTSTEEGSPA GSPTSTEEGA SISDKNTGDY

1401 YEDSYEDISA YLLSKNNAIE PRSFSDKTHT CPPCPAPELL GGPSVFLFPP

1451 KPKDTLMISR TPEVTCVVVD VSHEDPEVKF NWYVDGVEVH NAKTKPREEQ

1501 YNSTYRVVSV LTVLHQDWLN GKEYKCKVSN KALPAPIEKT ISKAKGQPRE

1551 PQVYTLPPSR DELTKNQVSL TCLVKGFYPS DIAVEWESNG QPENNYKTTP

1601 PVLDSDGSFF LYSKLTVDKS RWQQGNVFSC SVMHEALHNH YTQKSLSLSP

1651 GK*
``` pSYN VWF062 Nucleotide Sequence (Encoding VWF D'D3-Fc with No Thrombin Site in the Linker) (SEQ ID NO: 198)

```
  1 ATGATTCCTG CCAGATTTGC CGGGGTGCTG CTTGCTCTGG CCCTCATTTT

51 GCCAGGGACC CTTTGTGCAG AAGGAACTCG CGGCAGGTCA TCCACGGCCC

101 GATGCAGCCT TTTCGGAAGT GACTTCGTCA ACACCTTTGA TGGGAGCATG

151 TACAGCTTTG CGGGATACTG CAGTTACCTC CTGGCAGGGG CTGCCAGAA

201 ACGCTCCTTC TCGATTATTG GGACTTCCA GAATGGCAAG AGAGTGAGCC

251 TCTCCGTGTA TCTTGGGGAA TTTTTTGACA TCCATTTGTT TGTCAATGGT

301 ACCGTGACAC AGGGGGACCA AAGAGTCTCC ATGCCCTATG CCTCCAAAGG

351 GCTGTATCTA GAAACTGAGG CTGGGTACTA CAAGCTGTCC GGTGAGGCCT

401 ATGGCTTTGT GGCCAGGATC GATGGCAGCG GCAACTTTCA AGTCCTGCTG

451 TCAGACAGAT ACTTCAACAA GACCTGCGGG CTGTGTGGCA ACTTTAACAT

501 CTTTGCTGAA GATGACTTTA TGACCCAAGA AGGGACCTTG ACCTCGGACC

551 CTTATGACTT TGCCAACTCA TGGGCTCTGA GCAGTGGAGA ACAGTGGTGT

601 GAACGGGCAT CTCCTCCCAG CAGCTCATGC AACATCTCCT CTGGGGAAAT

651 GCAGAAGGGC CTGTGGGAGC AGTGCCAGCT TCTGAAGAGC ACCTCGGTGT

701 TTGCCCGCTG CCACCCTCTG GTGGACCCCG AGCCTTTTGT GGCCCTGTGT
```

```
 751 GAGAAGACTT TGTGTGAGTG TGCTGGGGGG CTGGAGTGCG CCTGCCCTGC

801 CCTCCTGGAG TACGCCCGGA CCTGTGCCCA GGAGGGAATG GTGCTGTACG

851 GCTGGACCGA CCACAGCGCG TGCAGCCCAG TGTGCCCTGC TGGTATGGAG

901 TATAGGCAGT GTGTGTCCCC TTGCGCCAGG ACCTGCCAGA GCCTGCACAT

951 CAATGAAATG TGTCAGGAGC GATGCGTGGA TGGCTGCAGC TGCCCTGAGG

1001 GACAGCTCCT GGATGAAGGC CTCTGCGTGG AGAGCACCGA GTGTCCCTGC

1051 GTGCATTCCG GAAAGCGCTA CCCTCCCGGC ACCTCCCTCT CTCGAGACTG

1101 CAACACCTGC ATTTGCCGAA ACAGCCAGTG GATCTGCAGC AATGAAGAAT

1151 GTCCAGGGGA GTGCCTTGTC ACTGGTCAAT CCCACTTCAA GAGCTTTGAC

1201 AACAGATACT TCACCTTCAG TGGGATCTGC CAGTACCTGC TGGCCCGGGA

1251 TTGCCAGGAC CACTCCTTCT CCATTGTCAT TGAGACTGTC CAGTGTGCTG

1301 ATGACCGCGA CGCTGTGTGC ACCCGCTCCG TCACCGTCCG GCTGCCTGGC

1351 CTGCACAACA GCCTTGTGAA ACTGAAGCAT GGGGCAGGAG TTGCCATGGA

1401 TGGCCAGGAC ATCCAGCTCC CCCTCCTGAA AGGTGACCTC CGCATCCAGC

1451 ATACAGTGAC GGCCTCCGTG CGCCTCAGCT ACGGGGAGGA CCTGCAGATG

1501 GACTGGGATG GCCGCGGGAG GCTGCTGGTG AAGCTGTCCC CCGTCTATGC

1551 CGGGAAGACC TGCGGCCTGT GTGGGAATTA CAATGGCAAC CAGGGCGACG

1601 ACTTCCTTAC CCCCTCTGGG CTGGCGGAGC CCCGGGTGGA GGACTTCGGG

1651 AACGCCTGGA AGCTGCACGG GGACTGCCAG GACCTGCAGA AGCAGCACAG

1701 CGATCCCTGC GCCCTCAACC CGCGCATGAC CAGGTTCTCC GAGGAGGCGT

1751 GCGCGGTCCT GACGTCCCCC ACATTCGAGG CCTGCCATCG TGCCGTCAGC

1801 CCGCTGCCCT ACCTGCGGAA CTGCCGCTAC GACGTGTGCT CCTGCTCGGA

1851 CGGCCGCGAG TGCCTGTGCG GCGCCCTGGC CAGCTATGCC GCGGCCTGCG

1901 CGGGGAGAGG CGTGCGCGTC GCGTGGCGCG AGCCAGGCCG CTGTGAGCTG

1951 AACTGCCCGA AAGGCCAGGT GTACCTGCAG TGCGGGACCC CCTGCAACCT

2001 GACCTGCCGC TCTCTCTCTT ACCCGGATGA GGAATGCAAT GAGGCCTGCC

2051 TGGAGGGCTG CTTCTGCCCC CCAGGGCTCT ACATGGATGA GAGGGGGGAC

2101 TGCGTGCCCA AGGCCCAGTG CCCCTGTTAC TATGACGGTG AGATCTTCCA

2151 GCCAGAAGAC ATCTTCTCAG ACCATCACAC CATGTGCTAC TGTGAGGATG

2201 GCTTCATGCA CTGTACCATG AGTGGAGTCC CCGGAAGCTT GCTGCCTGAC

2251 GCTGTCCTCA GCAGTCCCCT GTCTCATCGC AGCAAAAGGA GCCTATCCTG

2301 TCGGCCCCCC ATGGTCAAGC TGGTGTGTCC CGCTGACAAC CTGCGGGCTG

2351 AAGGGCTCGA GTGTACCAAA ACGTGCCAGA ACTATGACCT GGAGTGCATG

2401 AGCATGGGCT GTGTCTCTGG CTGCCTCTGC CCCCCGGGCA TGGTCCGGCA

2451 TGAGAACAGA TGTGTGGCCC TGGAAAGGTG TCCCTGCTTC CATCAGGGCA

2501 AGGAGTATGC CCCTGGAGAA ACAGTGAAGA TTGGCTGCAA CACTTGTGTC

2551 TGTCGGGACC GGAAGTGGAA CTGCACAGAC CATGTGTGTG ATGCCACGTG

2601 CTCCACGATC GGCATGGCCC ACTACCTCAC CTTCGACGGG CTCAAATACC

2651 TGTTCCCCGG GGAGTGCCAG TACGTTCTGG TGCAGGATTA CTGCGGCAGT

2701 AACCCTGGGA CCTTTCGGAT CCTAGTGGGG AATAAGGGAT GCAGCCACCC

2751 CTCAGTGAAA TGCAAGAAAC GGGTCACCAT CCTGGTGGAG GGAGGAGAGA
```

-continued

```
2801 TTGAGCTGTT TGACGGGGAG GTGAATGTGA AGAGGCCCAT GAAGGATGAG
2851 ACTCACTTTG AGGTGGTGGA GTCTGGCCGG TACATCATTC TGCTGCTGGG
2901 CAAAGCCCTC TCCGTGGTCT GGGACCGCCA CCTGAGCATC TCCGTGGTCC
2951 TGAAGCAGAC ATACCAGGAG AAAGTGTGTG GCCTGTGTGG GAATTTTGAT
3001 GGCATCCAGA ACAATGACCT CACCAGCAGC AACCTCCAAG TGGAGGAAGA
3051 CCCTGTGGAC TTTGGGAACT CCTGGAAAGT GAGCTCGCAG TGTGCTGACA
3101 CCAGAAAAGT GCCTCTGGAC TCATCCCCTG CCACCTGCCA TAACAACATC
3151 ATGAAGCAGA CGATGGTGGA TTCCTCCTGT AGAATCCTTA CCAGTGACGT
3201 CTTCCAGGAC TGCAACAAGC TGGTGGACCC CGAGCCATAT CTGGATGTCT
3251 GCATTTACGA CACCTGCTCC TGTGAGTCCA TTGGGGACTG CGCCGCATTC
3301 TGCGACACCA TTGCTGCCTA TGCCCACGTG TGTGCCCAGC ATGGCAAGGT
3351 GGTGACCTGG AGGACGGCCA CATTGTGCCC CCAGAGCTGC GAGGAGAGGA
3401 ATCTCCGGGA GAACGGGTAT GAGGCTGAGT GGCGCTATAA CAGCTGTGCA
3451 CCTGCCTGTC AAGTCACGTG TCAGCACCCT GAGCCACTGG CCTGCCCTGT
3501 GCAGTGTGTG GAGGGCTGCC ATGCCCACTG CCCTCCAGGG AAAATCCTGG
3551 ATGAGCTTTT GCAGACCTGC GTTGACCCTG AAGACTGTCC AGTGTGTGAG
3601 GTGGCTGGCC GGCGTTTTGC CTCAGGAAAG AAAGTCACCT TGAATCCCAG
3651 TGACCCTGAG CACTGCCAGA TTTGCCACTG TGATGTTGTC AACCTCACCT
3701 GTGAAGCCTG CCAGGAGCCG ATATCGGGCG CGCCAACATC AGAGAGCGCC
3751 ACCCCTGAAA GTGGTCCCGG GAGCGAGCCA GCCACATCTG GGTCGGAAAC
3801 GCCAGGCACA AGTGAGTCTG CAACTCCCGA GTCCGGACCT GGCTCCGAGC
3851 CTGCCACTAG CGGCTCCGAG ACTCCGGGAA CTTCCGAGAG CGCTACACCA
3901 GAAAGCGGAC CCGGAACCAG TACCGAACCT AGCGAGGGCT CTGCTCCGGG
3951 CAGCCCAGCC GGCTCTCCTA CATCCACGGA GGAGGGCACT TCCGAATCCG
4001 CCACCCCGGA GTCAGGGCCA GGATCTGAAC CCGCTACCTC AGGCAGTGAG
4051 ACGCCAGGAA CGAGCGAGTC CGCTACACCG GAGAGTGGGC CAGGGAGCCC
4101 TGCTGGATCT CCTACGTCCA CTGAGGAAGG GTCACCAGCG GGCTCGCCCA
4151 CCAGCACTGA AGAAGGTGCC TCGAGCGACA AAACTCACAC ATGCCCACCG
4201 TGCCCAGCTC CAGAACTCCT GGGCGGACCG TCAGTCTTCC TCTTCCCCCC
4251 AAAACCCAAG GACACCCTCA TGATCTCCCG GACCCCTGAG GTCACATGCG
4301 TGGTGGTGGA CGTGAGCCAC GAAGACCCTG AGGTCAAGTT CAACTGGTAC
4351 GTGGACGGCG TGGAGGTGCA TAATGCCAAG ACAAAGCCGC GGGAGGAGCA
4401 GTACAACAGC ACGTACCGTG TGGTCAGCGT CCTCACCGTC CTGCACCAGG
4451 ACTGGCTGAA TGGCAAGGAG TACAAGTGCA AGGTCTCCAA CAAAGCCCTC
4501 CCAGCCCCCA TCGAGAAAAC CATCTCCAAA GCCAAAGGGC AGCCCCGAGA
4551 ACCACAGGTG TACACCCTGC CCCCATCCCG GGATGAGCTG ACCAAGAACC
4601 AGGTCAGCCT GACCTGCCTG GTCAAAGGCT TCTATCCCAG CGACATCGCC
4651 GTGGAGTGGG AGAGCAATGG GCAGCCGGAG AACAACTACA AGACCACGCC
4701 TCCCGTGTTG GACTCCGACG GCTCCTTCTT CCTCTACAGC AAGCTCACCG
4751 TGGACAAGAG CAGGTGGCAG CAGGGGAACG TCTTCTCATG CTCCGTGATG
```

```
-continued
4801 CATGAGGCTC TGCACAACCA CTACACGCAG AAGAGCCTCT CCCTGTCTCC

4851 GGGTAAATGA
``` pSYN VWF062 Protein Sequence (VWF D'D3-Fc with No Thrombin Site in the Linker) (SEQ ID NO: 199)

```
   1 MIPARFAGVL LALALILPGT LCAEGTRGRS STARCSLFGS DFVNTFDGSM

51 YSFAGYCSYL LAGGCQKRSF SIIGDFQNGK RVSLSVYLGE FFDIHLFVNG

101 TVTQGDQRVS MPYASKGLYL ETEAGYYKLS GEAYGFVARI DGSGNFQVLL

151 SDRYFNKTCG LCGNFNIFAE DDFMTQEGTL TSDPYDFANS WALSSGEQWC

201 ERASPPSSSC NISSGEMQKG LWEQCQLLKS TSVFARCHPL VDPEPFVALC

251 EKTLCECAGG LECACPALLE YARTCAQEGM VLYGWTDHSA CSPVCPAGME

301 YRQCVSPCAR TCQSLHINEM CQERCVDGCS CPEGQLLDEG LCVESTECPC

351 VHSGKRYPPG TSLSRDCNTC ICRNSQWICS NEECPGECLV TGQSHFKSFD

401 NRYFTFSGIC QYLLARDCQD HSFSIVIETV QCADDRDAVC TRSVTVRLPG

451 LHNSLVKLKH GAGVAMDGQD IQLPLLKGDL RIQHTVTASV RLSYGEDLQM

501 DWDGRGRLLV KLSPVYAGKT CGLCGNYNGN QGDDFLTPSG LAEPRVEDFG

551 NAWKLHGDCQ DLQKQHSDPC ALNPRMTRFS EEACAVLTSP TFEACHRAVS

601 PLPYLRNCRY DVCSCSDGRE CLCGALASYA AACAGRGVRV AWREPGRCEL

651 NCPKGQVYLQ CGTPCNLTCR SLSYPDEECN EACLEGCFCP PGLYMDERGD

701 CVPKAQCPCY YDGEIFQPED IFSDHHTMCY CEDGFMHCTM SGVPGSLLPD

751 AVLSSPLSHR SKRSLSCRPP MVKLVCPADN LRAEGLECTK TCQNYDLECM

801 SMGCVSGCLC PPGMVRHENR CVALERCPCF HQGKEYAPGE TVKIGCNTCV

851 CRDRKWNCTD HVCDATCSTI GMAHYLTFDG LKYLFPGECQ YVLVQDYCGS

901 NPGTFRILVG NKGCSHPSVK CKKRVTILVE GGEIELFDGE VNVKRPMKDE

951 THFEVVESGR YIILLLGKAL SVVWDRHLSI SVVLKQTYQE KVCGLCGNFD

1001 GIQNNDLTSS NLQVEEDPVD FGNSWKVSSQ CADTRKVPLD SSPATCHNNI

1051 MKQTMVDSSC RILTSDVFQD CNKLVDPEPY LDVCIYDTCS CESIGDCAAF

1101 CDTIAAYAHV CAQHGKVVTW RTATLCPQSC EERNLRENGY EAEWRYNSCA

1151 PACQVTCQHP EPLACPVQCV EGCHAHCPPG KILDELLQTC VDPEDCPVCE

1201 VAGRRFASGK KVTLNPSDPE HCQICHCDVV NLTCEACQEP ISGAPTSESA

1251 TPESGPGSEP ATSGSETPGT SESATPESGP GSEPATSGSE TPGTSESATP

1301 ESGPGTSTEP SEGSAPGSPA GSPTSTEEGT SESATPESGP GSEPATSGSE

1351 TPGTSESATP ESGPGSPAGS PTSTEEGSPA GSPTSTEEGA SSDKTHTCPP

1401 CPAPELLGGP SVFLFPPKPK DTLMISRTPE VTCVVVDVSH EDPEVKFNWY

1451 VDGVEVHNAK TKPREEQYNS TYRVVSVLTV LHQDWLNGKE YKCKVSNKAL

1501 PAPIEKTISK AKGQPREPQV YTLPPSRDEL TKNQVSLTCL VKGFYPSDIA

1551 VEWESNGQPE NNYKTTPPVL DSDGSFFLYS KLTVDKSRWQ QGNVFSCSVM

1601 HEALHNHYTQ KSLSLSPGK*
``` pSYN VWF073 Nucleotide Sequence—(Encoding VWFD1D2D'D3-144 AE XTEN-FVIII Truncated a2 Thrombin Site-Fc) (SEQ ID NO:174)

```
   1 ATGATTCCTG CCAGATTTGC CGGGGTGCTG CTTGCTCTGG CCCTCATTTT
  51 GCCAGGGACC CTTTGTGCAG AAGGAACTCG CGGCAGGTCA TCCACGGCCC
 101 GATGCAGCCT TTTCGGAAGT GACTTCGTCA ACACCTTTGA TGGGAGCATG
 151 TACAGCTTTG CGGGATACTG CAGTTACCTC CTGGCAGGGG GCTGCCAGAA
 201 ACGCTCCTTC TCGATTATTG GGGACTTCCA GAATGGCAAG AGAGTGAGCC
 251 TCTCCGTGTA TCTTGGGGAA TTTTTTGACA TCCATTTGTT TGTCAATGGT
 301 ACCGTGACAC AGGGGGACCA AAGAGTCTCC ATGCCCTATG CCTCCAAAGG
 351 GCTGTATCTA GAAACTGAGG CTGGGTACTA CAAGCTGTCC GGTGAGGCCT
 401 ATGGCTTTGT GGCCAGGATC GATGGCAGCG GCAACTTTCA AGTCCTGCTG
 451 TCAGACAGAT ACTTCAACAA GACCTGCGGG CTGTGTGGCA ACTTTAACAT
 501 CTTTGCTGAA GATGACTTTA TGACCCAAGA AGGGACCTTG ACCTCGGACC
 551 CTTATGACTT TGCCAACTCA TGGGCTCTGA GCAGTGGAGA ACAGTGGTGT
 601 GAACGGGCAT CTCCTCCCAG CAGCTCATGC AACATCTCCT CTGGGGAAAT
 651 GCAGAAGGGC CTGTGGGAGC AGTGCCAGCT TCTGAAGAGC ACCTCGGTGT
 701 TTGCCCGCTG CCACCCTCTG GTGGACCCCG AGCCTTTTGT GGCCCTGTGT
 751 GAGAAGACTT TGTGTGAGTG TGCTGGGGGG CTGGAGTGCG CCTGCCCTGC
 801 CCTCCTGGAG TACGCCCGGA CCTGTGCCCA GGAGGGAATG GTGCTGTACG
 851 GCTGGACCGA CCACAGCGCG TGCAGCCCAG TGTGCCCTGC TGGTATGGAG
 901 TATAGGCAGT GTGTGTCCCC TTGCGCCAGG ACCTGCCAGA GCCTGCACAT
 951 CAATGAAATG TGTCAGGAGC GATGCGTGGA TGGCTGCAGC TGCCCTGAGG
1001 GACAGCTCCT GGATGAAGGC CTCTGCGTGG AGAGCACCGA GTGTCCCTGC
1051 GTGCATTCCG GAAAGCGCTA CCCTCCCGGC ACCTCCCTCT CTCGAGACTG
1101 CAACACCTGC ATTTGCCGAA ACAGCCAGTG GATCTGCAGC AATGAAGAAT
1151 GTCCAGGGGA GTGCCTTGTC ACTGGTCAAT CCCACTTCAA GAGCTTTGAC
1201 AACAGATACT TCACCTTCAG TGGGATCTGC CAGTACCTGC TGGCCCGGGA
1251 TTGCCAGGAC CACTCCTTCT CCATTGTCAT TGAGACTGTC CAGTGTGCTG
1301 ATGACCGCGA CGCTGTGTGC ACCCGCTCCG TCACCGTCCG GCTGCCTGGC
1351 CTGCACAACA GCCTTGTGAA ACTGAAGCAT GGGGCAGGAG TTGCCATGGA
1401 TGGCCAGGAC ATCCAGCTCC CCCTCCTGAA AGGTGACCTC CGCATCCAGC
1451 ATACAGTGAC GGCCTCCGTG CGCCTCAGCT ACGGGGAGGA CCTGCAGATG
1501 GACTGGGATG GCCGCGGGAG GCTGCTGGTG AAGCTGTCCC CGTCTATGC
1551 CGGGAAGACC TGCGGCCTGT GTGGGAATTA CAATGGCAAC CAGGGCGACG
1601 ACTTCCTTAC CCCCTCTGGG CTGGCGGAGC CCCGGGTGGA GGACTTCGGG
1651 AACGCCTGGA AGCTGCACGG GGACTGCCAG GACCTGCAGA AGCAGCACAG
1701 CGATCCCTGC GCCCTCAACC CGCGCATGAC CAGGTTCTCC GAGGAGGCGT
1751 GCGCGGTCCT GACGTCCCCC ACATTCGAGG CCTGCCATCG TGCCGTCAGC
1801 CCGCTGCCCT ACCTGCGGAA CTGCCGCTAC GACGTGTGCT CCTGCTCGGA
1851 CGGCCGCGAG TGCCTGTGCG GCGCCCTGGC CAGCTATGCC GCGGCCTGCG
```

-continued

```
1901 CGGGGAGAGG CGTGCGCGTC GCGTGGCGCG AGCCAGGCCG CTGTGAGCTG

1951 AACTGCCCGA AGGCCAGGT GTACCTGCAG TGCGGGACCC CCTGCAACCT

2001 GACCTGCCGC TCTCTCTCTT ACCCGGATGA GGAATGCAAT GAGGCCTGCC

2051 TGGAGGGCTG CTTCTGCCCC CCAGGGCTCT ACATGGATGA GAGGGGGGAC

2101 TGCGTGCCCA AGGCCCAGTG CCCCTGTTAC TATGACGGTG AGATCTTCCA

2151 GCCAGAAGAC ATCTTCTCAG ACCATCACAC CATGTGCTAC TGTGAGGATG

2201 GCTTCATGCA CTGTACCATG AGTGGAGTCC CCGGAAGCTT GCTGCCTGAC

2251 GCTGTCCTCA GCAGTCCCCT GTCTCATCGC AGCAAAAGGA GCCTATCCTG

2301 TCGGCCCCCC ATGGTCAAGC TGGTGTGTCC CGCTGACAAC CTGCGGGCTG

2351 AAGGGCTCGA GTGTACCAAA ACGTGCCAGA ACTATGACCT GGAGTGCATG

2401 AGCATGGGCT GTGTCTCTGG CTGCCTCTGC CCCCCGGGCA TGGTCCGGCA

2451 TGAGAACAGA TGTGTGGCCC TGGAAAGGTG TCCCTGCTTC CATCAGGGCA

2501 AGGAGTATGC CCCTGGAGAA ACAGTGAAGA TTGGCTGCAA CACTTGTGTC

2551 TGTCGGGACC GGAAGTGGAA CTGCACAGAC CATGTGTGTG ATGCCACGTG

2601 CTCCACGATC GGCATGGCCC ACTACCTCAC CTTCGACGGG CTCAAATACC

2651 TGTTCCCCGG GGAGTGCCAG TACGTTCTGG TGCAGGATTA CTGCGGCAGT

2701 AACCCTGGGA CCTTTCGGAT CCTAGTGGGG AATAAGGGAT GCAGCCACCC

2751 CTCAGTGAAA TGCAAGAAAC GGGTCACCAT CCTGGTGGAG GGAGGAGAGA

2801 TTGAGCTGTT TGACGGGGAG GTGAATGTGA AGAGGCCCAT GAAGGATGAG

2851 ACTCACTTTG AGGTGGTGGA GTCTGGCCGG TACATCATTC TGCTGCTGGG

2901 CAAAGCCCTC TCCGTGGTCT GGGACCGCCA CCTGAGCATC TCCGTGGTCC

2951 TGAAGCAGAC ATACCAGGAG AAAGTGTGTG GCCTGTGTGG GAATTTTGAT

3001 GGCATCCAGA ACAATGACCT CACCAGCAGC AACCTCCAAG TGGAGGAAGA

3051 CCCTGTGGAC TTTGGGAACT CCTGGAAAGT GAGCTCGCAG TGTGCTGACA

3101 CCAGAAAAGT GCCTCTGGAC TCATCCCCTG CCACCTGCCA TAACAACATC

3151 ATGAAGCAGA CGATGGTGGA TTCCTCCTGT AGAATCCTTA CCAGTGACGT

3201 CTTCCAGGAC TGCAACAAGC TGGTGGACCC CGAGCCATAT CTGGATGTCT

3251 GCATTTACGA CACCTGCTCC TGTGAGTCCA TTGGGGACTG CGCCGCATTC

3301 TGCGACACCA TTGCTGCCTA TGCCCACGTG TGTGCCCAGC ATGGCAAGGT

3351 GGTGACCTGG AGGACGGCCA CATTGTGCCC CCAGAGCTGC GAGGAGAGGA

3401 ATCTCCGGGA GAACGGGTAT GAGGCTGAGT GGCGCTATAA CAGCTGTGCA

3451 CCTGCCTGTC AAGTCACGTG TCAGCACCCT GAGCCACTGG CCTGCCCTGT

3501 GCAGTGTGTG GAGGGCTGCC ATGCCCACTG CCCTCCAGGG AAAATCCTGG

3551 ATGAGCTTTT GCAGACCTGC GTTGACCCTG AAGACTGTCC AGTGTGTGAG

3601 GTGGCTGGCC GGCGTTTTGC CTCAGGAAAG AAAGTCACCT TGAATCCCAG

3651 TGACCCTGAG CACTGCCAGA TTTGCCACTG TGATGTTGTC AACCTCACCT

3701 GTGAAGCCTG CCAGGAGCCG GGCGCGCCAA CATCAGAGAG CGCCACCCCT

3751 GAAAGTGGTC CCGGGAGCGA GCCAGCCACA TCTGGGTCGG AAACGCCAGG

3801 CACAAGTGAG TCTGCAACTC CCGAGTCCGG ACCTGGCTCC GAGCCTGCCA

3851 CTAGCGGCTC CGAGACTCCG GAACTTCCG AGAGCGCTAC ACCAGAAAGC

3901 GGACCCGGAA CCAGTACCGA ACCTAGCGAG GGCTCTGCTC CGGGCAGCCC
```

```
3951 AGCCGGCTCT CCTACATCCA CGGAGGAGGG CACTTCCGAA TCCGCCACCC
4001 CGGAGTCAGG GCCAGGATCT GAACCCGCTA CCTCAGGCAG TGAGACGCCA
4051 GGAACGAGCG AGTCCGCTAC ACCGGAGAGT GGGCCAGGGA GCCCTGCTGG
4101 ATCTCCTACG TCCACTGAGG AAGGGTCACC AGCGGGCTCG CCCACCAGCA
4151 CTGAAGAAGG TGCCTCGAGC GGCGGTGGAG GATCCGGTGG CGGGGGATCC
4201 GGTGGCGGGG GATCCGGTGG CGGGGGATCC GGTGGCGGGG GATCCGGTGG
4251 CGGGGGATCC ATTGAACCAA GAAGCTTCTC TGGCAGCGGA GGCGACAAAA
4301 CTCACACATG CCCACCGTGC CCAGCTCCAG AACTCCTGGG CGGACCGTCA
4351 GTCTTCCTCT TCCCCCCAAA ACCCAAGGAC ACCCTCATGA TCTCCCGGAC
4401 CCCTGAGGTC ACATGCGTGG TGGTGGACGT GAGCCACGAA GACCCTGAGG
4451 TCAAGTTCAA CTGGTACGTG GACGGCGTGG AGGTGCATAA TGCCAAGACA
4501 AAGCCGCGGG AGGAGCAGTA CAACAGCACG TACCGTGTGG TCAGCGTCCT
4551 CACCGTCCTG CACCAGGACT GGCTGAATGG CAAGGAGTAC AAGTGCAAGG
4601 TCTCCAACAA AGCCCTCCCA GCCCCCATCG AGAAAACCAT CTCCAAAGCC
4651 AAAGGGCAGC CCCGAGAACC ACAGGTGTAC ACCCTGCCCC CATCCCGGGA
4701 TGAGCTGACC AAGAACCAGG TCAGCCTGAC CTGCCTGGTC AAAGGCTTCT
4751 ATCCCAGCGA CATCGCCGTG GAGTGGGAGA GCAATGGGCA GCCGGAGAAC
4801 AACTACAAGA CCACGCCTCC CGTGTTGGAC TCCGACGGCT CCTTCTTCCT
4851 CTACAGCAAG CTCACCGTGG ACAAGAGCAG GTGGCAGCAG GGGAACGTCT
4901 TCTCATGCTC CGTGATGCAT GAGGCTCTGC ACAACCACTA CACGCAGAAG
4951 AGCCTCTCCC TGTCTCCGGG TAAATGA
``` pSYN VWF073 Protein Sequence— (VWFD1D2D'D3-144 AE XTEN-Truncated a2 Thrombin Site-Fc) (SEQ ID NO:175)

```
  1 MIPARFAGVL LALALILPGT LCAEGTRGRS STARCSLFGS DFVNTFDGSM
 51 YSFAGYCSYL LAGGCQKRSF SIIGDFQNGK RVSLSVYLGE FFDIHLFVNG
101 TVTQGDQRVS MPYASKGLYL ETEAGYYKLS GEAYGFVARI DGSGNFQVLL
151 SDRYFNKTCG LCGNFNIFAE DDFMTQEGTL TSDPYDFANS WALSSGEQWC
201 ERASPPSSSC NISSGEMQKG LWEQCQLLKS TSVFARCHPL VDPEPFVALC
251 EKTLCECAGG LECACPALLE YARTCAQEGM VLYGWTDHSA CSPVCPAGME
301 YRQCVSPCAR TCQSLHINEM CQERCVDGCS CPEGQLLDEG LCVESTECPC
351 VHSGKRYPPG TSLSRDCNTC ICRNSQWICS NEECPGECLV TGQSHFKSFD
401 NRYFTFSGIC QYLLARDCQD HSFSIVIETV QCADDRDAVC TRSVTVRLPG
451 LHNSLVKLKH GAGVAMDGQD IQLPLLKGDL RIQHTVTASV RLSYGEDLQM
501 DWDGRGRLLV KLSPVYAGKT CGLCGNYNGN QGDDFLTPSG LAEPRVEDFG
551 NAWKLHGDCQ DLQKQHSDPC ALNPRMTRFS EEACAVLTSP TFEACHRAVS
```

```
 601  PLPYLRNCRY DVCSCSDGRE CLCGALASYA AACAGRGVRV AWREPGRCEL

651  NCPKGQVYLQ CGTPCNLTCR SLSYPDEECN EACLEGCFCP PGLYMDERGD

701  CVPKAQCPCY YDGEIFQPED IFSDHHTMCY CEDGFMHCTM SGVPGSLLPD

751  AVLSSPLSHR SKRSLSCRPP MVKLVCPADN LRAEGLECTK TCQNYDLECM

801  SMGCVSGCLC PPGMVRHENR CVALERCPCF HQGKEYAPGE TVKIGCNTCV

851  CRDRKWNCTD HVCDATCSTI GMAHYLTFDG LKYLFPGECQ YVLVQDYCGS

901  NPGTFRILVG NKGCSHPSVK CKKRVTILVE GGEIELFDGE VNVKRPMKDE

951  THFEVVESGR YIILLLGKAL SVVWDRHLSI SVVLKQTYQE KVCGLCGNFD

1001  GIQNNDLTSS NLQVEEDPVD FGNSWKVSSQ CADTRKVPLD SSPATCHNNI

1051  MKQTMVDSSC RILTSDVFQD CNKLVDPEPY LDVCIYDTCS CESIGDCAAF

1101  CDTIAAYAHV CAQHGKVVTW RTATLCPQSC EERNLRENGY EAEWRYNSCA

1151  PACQVTCQHP EPLACPVQCV EGCHAHCPPG KILDELLQTC VDPEDCPVCE

1201  VAGRRFASGK KVTLNPSDPE HCQICHCDVV NLTCEACQEP GAPTSESATP

1251  ESGPGSEPAT SGSETPGTSE SATPESGPGS EPATSGSETP GTSESATPES

1301  GPGTSTEPSE GSAPGSPAGS PTSTEEGTSE SATPESGPGS EPATSGSETP

1351  GTSESATPES GPGSPAGSPT STEEGSPAGS PTSTEEGASS GGGGSGGGGS

1401  GGGGSGGGGS GGGGSGGGGS IEPRSFSGSG GDKTHTCPPC PAPELLGGPS

1451  VFLFPPKPKD TLMISRTPEV TCVVVDVSHE DPEVKFNWYV DGVEVHNAKT

1501  KPREEQYNST YRVVSVLTVL HQDWLNGKEY KCKVSNKALP APIEKTISKA

1551  KGQPREPQVY TLPPSRDELT KNQVSLTCLV KGFYPSDIAV EWESNGQPEN

1601  NYKTTPPVLD SDGSFFLYSK LTVDKSRWQQ GNVFSCSVMH EALHNHYTQK

1651  SLSLSPGK*
```

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

Other embodiments of the invention will be apparent to those skilled in the art from consideration of the specification and practice of the invention disclosed herein. It is intended that the specification and examples be considered as exemplary only, with a true scope and spirit of the invention being indicated by the following claims.

All patents and publications cited herein are incorporated by reference herein in their entirety.

SEQUENCE LISTING (202 sequences)

SEQ ID NO: 1 - protein, 9 aa, Artificial Sequence
  Linker
TQSFNDFTR

SEQ ID NO: 2 - protein, 302 aa, Artificial Sequence
  pSYN FVIII 312A
PRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 3 - protein, 10 aa, Artificial Sequence
  Linker
SVSQTSKLTR

SEQ ID NO: 4 - protein, 10 aa, Artificial Sequence
  Linker
DFLAEGGGVR

SEQ ID NO: 5 - protein, 7 aa, Artificial Sequence
  Linker
TTKIKPR

SEQ ID NO: 6 - protein, 5 aa, Artificial Sequence
  Linker
LVPRG

SEQ ID NO: 7 - protein, 5 aa, Artificial Sequence
  Linker
ALRPR

SEQ ID NO: 8 - protein, 288 aa, Artificial Sequence
  XTEN AE288
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 9 - protein, 42 aa, Artificial Sequence
  XTEN AE42
GAPGSPAGSPTSTEEGTSESATPESGPGSEPATSGSETPASS

SEQ ID NO: 10 - protein, 78 aa, Artificial Sequence
  XTEN AE72
GAPTSESATPESGPGSEPATSGSETPGTSESATPESGPGSEPATSGSETPGTSESATPESGPGTSTEPSEGSAPGASS

SEQ ID NO: 11 - protein, 143 aa, Artificial Sequence
  XTEN AE144
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESAPESGPGSEPATSGSETPGTSTEPSEGSAP

SEQ ID NO: 12 - protein, 56 aa, Artificial Sequence
  pSYN VWF057
TSTEEGASSGGGGSGGGGSGGGGSGGGGSGGGGSGGGGSGGGGSLVPRGSGGDKTH

SEQ ID NO: 13 - protein, 46 aa, Artificial Sequence
  pSYN VWF059
TSTEEGASISDKNTGDYYEDSYEDISAYLLSKNNAIEPRSFSDKTH

SEQ ID NO: 14 - protein, 144 aa, Artificial Sequence
  XTEN AG144
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 15 - protein, 864 aa, Artificial Sequence
  XTEN AE864
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 16 - protein, 576 aa, Artificial Sequence
  XTEN AE576
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 17 - protein, 864 aa, Artificial Sequence
  XTEN AG864
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 18 - protein, 576 aa, Artificial Sequence
  XTEN AG576
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 19 - protein, 288 aa, Artificial Sequence
  XTEN AG288
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 20 - DNA, 8442 bp, Homo sapiens
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgygtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagstgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtcttgctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 21 - protein, 2813 aa, Homo sapiens
  misc_feature (2016)..(2016): Xaa can be any naturally occurring amino acid
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVEXHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 22 - protein, 45 aa, Artificial Sequence
  pSYN VWF059A
TSTEEGASSDKNTGDYYEDSYEDISAYLLSKNNAIEPRSFSDKTH

SEQ ID NO: 23 - protein, 54 aa, Artificial Sequence
  pSYN VWF073
TSTEEGASSGGGGSGGGGSGGGGSGGGGSGGGGSGGGGSIEPRSFSGSGGDKTH

SEQ ID NO: 24 - protein, 12 aa, Artificial Sequence
  XTEN Motif Family AD
GESPGGSSGSES

SEQ ID NO: 25 - protein, 12 aa, Artificial Sequence
  XTEN Motif Family AD
GSEGSSGPGESS

SEQ ID NO: 26 - protein, 12 aa, Artificial Sequence
  XTEN Motif Family AD
GSSESGSSEGGP

SEQ ID NO: 27 - protein, 12 aa, Artificial Sequence
  XTEN Motif Family AD
GSGGEPSESGSS

SEQ ID NO: 28 - protein, 12 aa, Artificial Sequence
  XTEN Motif Families AE, AM
GSPAGSPTSTEE

SEQ ID NO: 29 - protein, 12 aa, Artificial Sequence
  XTEN Motif Families AE, AM, AQ
GSEPATSGSETP

SEQ ID NO: 30 - protein, 12 aa, Artificial Sequence
  XTEN Motif Families AE, AM, AQ
GTSESATPESGP

SEQ ID NO: 31 - protein, 12 aa, Artificial Sequence
  XTEN Motif Families AE, AM, AQ
GTSTEPSEGSAP

SEQ ID NO: 32 - protein, 12 aa, Artificial Sequence
  XTEN Motif Families AF, AM
GSTSESPSGTAP

SEQ ID NO: 33 - protein, 12 aa, Artificial Sequence
  XTEN Motif Families AF, AM
GTSTPESGSASP

SEQ ID NO: 34 - protein, 12 aa, Artificial Sequence
  AF, AM
GTSPSGESSTAP

SEQ ID NO: 35 - protein, 12 aa, Artificial Sequence
  XTEN Motif Families AF, AM
GSTSSTAESPGP

SEQ ID NO: 36 - protein, 12 aa, Artificial Sequence
  XTEN Motif Families AG, AM
GTPGSGTASSSP

SEQ ID NO: 37 - protein, 12 aa, Artificial Sequence
  XTEN Motif Families AG, AM
GSSTPSGATGSP

SEQ ID NO: 38 - protein, 12 aa, Artificial Sequence
  XTEN Motif Families AG, AM
GSSPSASTGTGP

SEQ ID NO: 39 - protein, 12 aa, Artificial Sequence
  XTEN Motif Families AG, AM
GASPGTSSTGSP

SEQ ID NO: 40 - protein, 12 aa, Artificial Sequence
  XTEN Motif Family AQ
GEPAGSPTSTSE

SEQ ID NO: 41 - protein, 12 aa, Artificial Sequence
  XTEN Motif Family AQ
GTGEPSSTPASE

SEQ ID NO: 42 - protein, 12 aa, Artificial Sequence
  XTEN Motif Family AQ
GSGPSTESAPTE

SEQ ID NO: 43 - protein, 12 aa, Artificial Sequence
  XTEN Motif Family AQ
GSETPSGPSETA

SEQ ID NO: 44 - protein, 12 aa, Artificial Sequence
  XTEN Motif Family AQ
GPSETSTSEPGA

SEQ ID NO: 45 - protein, 12 aa, Artificial Sequence
  XTEN Motif Family AQ
GSPSEPTEGTSA

SEQ ID NO: 46 - protein, 12 aa, Artificial Sequence
  XTEN Motif Family BC
GSGASEPTSTEP

SEQ ID NO: 47 - protein, 12 aa, Artificial Sequence
  XTEN Motif Family BC
GSEPATSGTEPS

SEQ ID NO: 48 - protein, 12 aa, Artificial Sequence
  XTEN Motif Family BC
GTSEPSTSEPGA

SEQ ID NO: 49 - protein, 12 aa, Artificial Sequence
  XTEN Family Motif BC
GTSTEPSEPGSA

SEQ ID NO: 50 - protein, 12 aa, Artificial Sequence
  XTEN Motif Family BD
GSTAGSETSTEA

SEQ ID NO: 51 - protein, 12 aa, Artificial Sequence
  XTEN Motif Family BD
GSETATSGSETA

SEQ ID NO: 52 - protein, 12 aa, Artificial Sequence
  XTEN Motif Family BD
GTSESATSESGA

SEQ ID NO: 53 - protein, 12 aa, Artificial Sequence
  XTEN Motif Family BD
GTSTEASEGSAS

SEQ ID NO: 54 - protein, 288 aa, Artificial Sequence
  XTEN AE288_2
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 55 - protein, 143 aa, Artificial Sequence
  XTEN AE144_2A
STEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 56 - protein, 144 aa, Artificial Sequence
  XTEN AE144_3B
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 57 - protein, 144 aa, Artificial Sequence
  XTEN AE144_4A
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 58 - protein, 144 aa, Artificial Sequence
  XTEN AE144_5A
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 59 - protein, 144 aa, Artificial Sequence
  XTEN AE144_6B
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 60 - protein, 144 aa, Artificial Sequence
  XTEN AG144_A
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 61 - protein, 144 aa, Artificial Sequence
  XTEN AG144_B
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 62 - protein, 144 aa, Artificial Sequence
  XTEN AG144_C
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 63 - protein, 144 aa, Artificial Sequence
  AG144_F
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 64 - protein, 19 aa, Artificial Sequence
  FVIII Signal Peptide
MQIELSTCFFLCLLRFCFS

SEQ ID NO: 65 - protein, 2332 aa, Artificial Sequence
  Mature Factor VIII
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 66 - DNA, 7053 bp, Artificial Sequence
  Full-Length FVIII
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 67 - protein, 1438 aa, Artificial Sequence
  BDD FVIII
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 68 - DNA, 4371 bp, Artificial Sequence
  BDD FVIII
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 69 - protein, 2754 aa, Artificial Sequence
  pSYN-FVIII-161
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRRRRSGGGGSGGGGSGGGGSGGGGSGGGGSGGGGSRKRRKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 1978 aa, Artificial Sequence
  FVIII 169
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 2242 aa, Artificial Sequence
  pSYN-FVIII-170
SLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGASATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 72 - protein, 1959 aa, Artificial Sequence
  pSYN-FVIII-173
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 1984 aa, Artificial Sequence
  FVIII 195 (dual chain FVIIIFc with two 144 AE XTENs at amino acid 1656 and 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 2134 aa, Artificial Sequence
  FVIII 196 (dual chain FVIIIFc with three 144 AE XTENs at amino acid 26, 1656 and 1900)
MQIELSTCFFLCLLRFCFSATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 1984 aa, Artificial Sequence
  FVIII 199 (single chain FVIIIFc with three 144 AE XTENs at amino acid 1656 and 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 2134 aa, Artificial Sequence
  FVIII 201 (single chain FVIIIFc with three 144 AE XTENs at amino acid 26, 1656 &1900)
MQIELSTCFFLCLLRFCFSATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 2128 aa, Artificial Sequence
  FVIII 203 (single chain FVIIIFc with two AE XTENs, one 288AE XTEN in B-domain and one 144 AE XTEN at amino acid 1900)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 2128 aa, Artificial Sequence
  FVIII 204 (single chain FVIIIFc with two AE XTENs, one 288AE XTEN in B-domain and one 144 AE XTEN at amino acid 403)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 2128 aa, Artificial Sequence
  FVIII 205 (single chain FVIIIFc with two AE XTEN, one 288AE XTEN in B-domain and one 144 AE XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 2020 aa, Artificial Sequence
  pSYN FVIII 266  (FVIII Fc with 42 AE-XTEN at amino acid 18 and 288 AE XTEN in B-domain)
MQIELSTCFFLCLLRFCFSATRRYYLGAVELSWDYMQGAPGSPAGSPTSTEEGTSESATPESGPGSEPATSGSETPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 2056 aa, Artificial Sequence
  pSYN FVIII 267 (FVIII Fc with 72 AE-XTEN at amino acid  18 and 288 AE XTEN in B-domain)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 1834 aa, Artificial Sequence
  pSYN FVIII 268 (FVIII Fc with 144 AE-XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 1762 aa, Artificial Sequence
  pSYN FVIII 269 (FVIII Fc with 72 AE-XTEN at amino acid 18)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 1726 aa, Artificial Sequence
  pSYNFVIII  271 (FVIII Fc with 42 AE-XTEN at amino acid 18)
MQIELSTCFFLCLLRFCFSATRRYYLGAVELSWDYMQGAPGSPAGSPTSTEEGTSESATPESGPGSEPATSGSETPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 1901 aa, Artificial Sequence
  pSYN FVIII 272 ( FVIII with 144 AE XTEN at amino acid 18 and 244 AE XTEN in B-domain- no Fc)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 86 - protein, 1515 aa, Artificial Sequence
  VWF031
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGGGGSGGGGSGGGGSGGGGSGGGGSGGGGSLVPRGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 1778 aa, Artificial Sequence
  VWF034
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDIGGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 32 aa, Artificial Sequence
  Cleavable linker
DKNTGDYYEDSYEDISAYLLSKNNAIEPRSFS

SEQ ID NO: 89 - protein, 11 aa, Artificial Sequence
  Ig constant region portion
PKNSSMISNTP

SEQ ID NO: 90 - protein, 7 aa, Artificial Sequence
  Ig constant region portion
HQSLGTQ

SEQ ID NO: 91 - protein, 8 aa, Artificial Sequence
  Ig constant region portion
HQNLSDGK

SEQ ID NO: 92 - protein, 8 aa, Artificial Sequence
  Ig constant region portion
HQNISDGK

SEQ ID NO: 93 - protein, 8 aa, Artificial Sequence
  Ig constant region portion
VISSHLGQ

SEQ ID NO: 94 - protein, 5 aa, Artificial Sequence
  Linker, where the sequence can repeated between 1-20 times
GGGGS

SEQ ID NO: 95 - protein, 8 aa, Artificial Sequence
  Linker, where the sequence can be repeated between 1-100 times or 1-20 times
GGSGGGGS

SEQ ID NO: 96 - protein, 7 aa, Artificial Sequence
  Linker
SGGSGGS

SEQ ID NO: 97 - protein, 15 aa, Artificial Sequence
  Linker
GGSGGSGGSGGSGGG

SEQ ID NO: 98 - protein, 16 aa, Artificial Sequence
  Linker
GGSGGSGGGGSGGGGS

SEQ ID NO: 99 - protein, 18 aa, Artificial Sequence
  Linker
GGSGGSGGSGGSGGSGGS

SEQ ID NO: 100 - protein, 15 aa, Artificial Sequence
  Linker
GGGGSGGGGSGGGGS

SEQ ID NO: 101 - protein, 4 aa, Artificial Sequence
  Linker, where the sequence can be repeated between 1-00 times or 1-20 times
GGGS

SEQ ID NO: 102 - protein, 4 aa, Artificial Sequence
  Cleavage site
RRRR

SEQ ID NO: 103 - protein, 6 aa, Artificial Sequence
  Cleavage site
RKRRKR

SEQ ID NO: 104 - protein, 5 aa, Artificial Sequence
  Cleavage site
RRRRS

SEQ ID NO: 105 - protein, 4 aa, Artificial Sequence
  Thrombin cleavable site
  misc_feature (1)..(1): Xaa is an aliphatic amino acid
XVPR

SEQ ID NO: 106 - protein, 34 aa, Artificial Sequence
  Cleavable linker
ISDKNTGDYYEDSYEDISAYLLSKNNAIEPRSFS

SEQ ID NO: 107 - protein, 40 aa, Artificial Sequence
  Cleavable linker
ISMKNNEEAEDYDDDLTDSEMDVVRFDDDNSPSFIQIRSV

SEQ ID NO: 108 - protein, 46 aa, Artificial Sequence
  Cleavable linker
ISEITRTTLQSDQEEIDYDDTISVEMKKEDFDIYDEDENQSPRSFQ

SEQ ID NO: 109 - protein, 6 aa, Artificial Sequence
  PAR1 exosite interaction motif
SFLLRN

SEQ ID NO: 110 - protein, 4 aa, Artificial Sequence
  PAR1 exosite interaction motif
PNDK

SEQ ID NO: 111 - protein, 5 aa, Artificial Sequence
  PAR1 exosite interaction motif
PNDKY

SEQ ID NO: 112 - protein, 6 aa, Artificial Sequence
  PAR1 exosite interaction motif
PNDKYE

SEQ ID NO: 113 - protein, 7 aa, Artificial Sequence
  PAR1 exosite interaction motif
PNDKYEP

SEQ ID NO: 114 - protein, 8 aa, Artificial Sequence
  PAR1 exosite interaction motif
PNDKYEPF

SEQ ID NO: 115 - protein, 9 aa, Artificial Sequence
  PAR1 exosite interaction motif
PNDKYEPFW

SEQ ID NO: 116 - protein, 10 aa, Artificial Sequence
  PAR1 exosite interaction motif
PNDKYEPFWE

SEQ ID NO: 117 - protein, 11 aa, Artificial Sequence
  PAR1 exosite interaction motif
PNDKYEPFWED

SEQ ID NO: 118 - protein, 12 aa, Artificial Sequence
  PAR1 exosite interaction motif
PNDKYEPFWEDE

SEQ ID NO: 119 - protein, 13 aa, Artificial Sequence
  PAR1 exosite interaction motif
PNDKYEPFWEDEE

SEQ ID NO: 120 - protein, 14 aa, Artificial Sequence
  PAR1 exosite interaction motif
PNDKYEPFWEDEES

SEQ ID NO: 121 - protein, 7 aa, Artificial Sequence
  FXIa cleavage site
KLTRAET

SEQ ID NO: 122 - protein, 7 aa, Artificial Sequence
  FXIa cleavage site
DFTRVVG

SEQ ID NO: 123 - protein, 8 aa, Artificial Sequence
  FXIIa cleavage site
TMTRIVGG

SEQ ID NO: 124 - protein, 8 aa, Artificial Sequence
  Kallikrein cleavage site
SPFRSTGG

SEQ ID NO: 125 - protein, 8 aa, Artificial Sequence
  FVIIa cleavage site
LQVRIVGG

SEQ ID NO: 126 - protein, 8 aa, Artificial Sequence
  FIXa cleavage site
PLGRIVGG

SEQ ID NO: 127 - protein, 8 aa, Artificial Sequence
  FXa cleavage site
IEGRTVGG

SEQ ID NO: 128 - protein, 8 aa, Artificial Sequence
  FIIa (thrombin) cleavage site
LTPRSLLV

SEQ ID NO: 129 - protein, 8 aa, Artificial Sequence
  Elastase-2 cleavage site
LGPVSGVP

SEQ ID NO: 130 - protein, 8 aa, Artificial Sequence
  Granzyme-B cleavage
VAGDSLEE

SEQ ID NO: 131 - protein, 8 aa, Artificial Sequence
  MMP-12 cleavage site
GPAGLGGA

SEQ ID NO: 132 - protein, 8 aa, Artificial Sequence
  MMP-13 cleavage site
GPAGLRGA

SEQ ID NO: 133 - protein, 8 aa, Artificial Sequence
  MMP-17 cleavage site
APLGLRLR

SEQ ID NO: 134 - protein, 8 aa, Artificial Sequence
  MMP-20 cleavage site
PALPLVAQ

SEQ ID NO: 135 - protein, 7 aa, Artificial Sequence
  TEV cleavage site
ENLYFQG

SEQ ID NO: 136 - protein, 8 aa, Artificial Sequence
  Enterokinase cleavage site
DDDKIVGG

SEQ ID NO: 137 - protein, 8 aa, Artificial Sequence
  Protease 3C (PRESCISSION) cleavage site
LEVLFQGP

SEQ ID NO: 138 - protein, 8 aa, Artificial Sequence
  Sortase A cleavage site
LPKTGSES

SEQ ID NO: 139 - protein, 31 aa, Artificial Sequence
  Cleavable linker
KNTGDYYEDSYEDISAYLLSKNNAIEPRSFS

SEQ ID NO: 140 - protein, 30 aa, Artificial Sequence
  Cleavable linker
NTGDYYEDSYEDISAYLLSKNNAIEPRSFS

SEQ ID NO: 141 - protein, 29 aa, Artificial Sequence
  Cleavable linker
TGDYYEDSYEDISAYLLSKNNAIEPRSFS

SEQ ID NO: 142 - protein, 28 aa, Artificial Sequence
  Cleavable linker
GDYYEDSYEDISAYLLSKNNAIEPRSFS

SEQ ID NO: 143 - protein, 27 aa, Artificial Sequence
  Cleavable linker
DYYEDSYEDISAYLLSKNNAIEPRSFS

SEQ ID NO: 144 - protein, 26 aa, Artificial Sequence
  Cleavable linker
YYEDSYEDISAYLLSKNNAIEPRSFS

SEQ ID NO: 145 - protein, 10 aa, Artificial Sequence
  Thrombin cleavage site
ALRPRVVGGA

SEQ ID NO: 146 - protein, 25 aa, Artificial Sequence
  Linker
TLDPRSFLLRNPNDKYEPFWEDEEK

SEQ ID NO: 147 - DNA, 4548 bp, Artificial Sequence
  VWF031
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatctggcggtggaggttccggtggcgggggatccggcggtggaggttccggcggtggaggttccggtggcgggggatccggtggcgggggatccctggtcccccggggcagcggcggtggaggttccggtggcgggggatccgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 148 - DNA, 5379 bp, Artificial Sequence
  VWF034
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagattctggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 149 - DNA, 4548 bp, Artificial Sequence
  VWF050 (IHH triple mutant)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatctggcggtggaggttccggtggcgggggatccggcggtggaggttccggcggtggaggttccggtggcgggggatccggtggcgggggatccctggtcccccggggcagcggcggtggaggttccggtggcgggggatccgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 150 - protein, 1515 aa, Artificial Sequence
  VWF050 (IHH triple mutant)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGGGGSGGGGSGGGGSGGGGSGGGGSGGGGSLVPRGSGGGGSGGGGSDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 151 - DNA, 4959 bp, Artificial Sequence
  VWF057
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 152 - protein, 1652 aa, Artificial Sequence
  VWF057
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSGGGGSGGGGSGGGGSGGGGSGGGGSLVPRGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - DNA, 5379 bp, Artificial Sequence
  VWF058 (VWF034 with IHH mutation)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagattctggcggtggaggttccggtggcgggggatccggtggcgggggatccggtggcgggggatccggtggcgggggatccctggtcccccggggcagcggaggcgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 154 - protein, 1792 aa, Artificial Sequence
  VWF058 (VWF034 with IHH mutation)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPDSGGGGSGGGGSGGGGSGGGGSGGGGSLVPRGSGGDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 155 - DNA, 5937 bp, Artificial Sequence
  FVIII 169
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 156 - DNA, 6387 bp, Artificial Sequence
  FVIII 263 (IHH triple mutant)
atgcaaatagagctctccacctgcttctttctgtgccttttgcgattctgctttagtgccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 157 - protein, 2128 aa, Artificial Sequence
  FVIII 263 (IHH triple mutant)
MQIELSTCFFLCLLRFCFSATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 158 - DNA, 5505 bp, Artificial Sequence
  FVIII 282
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 159 - protein, 1834 aa, Artificial Sequence
  FVIII 282
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - DNA, 5937 bp, Artificial Sequence
  FVIII 283 (FVIII 169 with IHH triple mutation)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatggcctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctggcccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaacgcctacacgcagaagagcctctccctgtctccgggtaaatga

SEQ ID NO: 161 - protein, 1978 aa, Artificial Sequence
  FVIII 283 (FVIII 169 with IHH triple mutation)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 162 - DNA, 5055 bp, Artificial Sequence
  pSYNFVIII 010 (Dual chain FVIIIFc)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 163 - protein, 1684 aa, Artificial Sequence
  pSYNFVIII 010 (Dual chain FVIIIFc)
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 6 aa, Artificial Sequence
  Linker, where the sequence can be repeated betweeen 1-10 times
SGGGGS

SEQ ID NO: 165 - protein, 20 aa, Artificial Sequence
  Linker
GGGGSGGGGSGGGGSGGGGS

SEQ ID NO: 166 - protein, 34 aa, Artificial Sequence
  Linker
SGGGGSGGGGSGGGGSGGGGSGGGGSLVPRGSGG

SEQ ID NO: 167 - protein, 314 aa, Artificial Sequence
  pSYN FVIII 169
PRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITR

SEQ ID NO: 168 - protein, 302 aa, Artificial Sequence
  pSYN FVIII 310
PRSFGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 169 - protein, 305 aa, Artificial Sequence
  pSYN FVIII 312
PRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITR

SEQ ID NO: 170 - DNA, 5892 bp, Artificial Sequence
  pSYN FVIII 310 (encoding FVIII with complete B-domain deletion except 2 amino acid residues and 288 AE-XTEN inserted after aa 742)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttcggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 171 - protein, 1944 aa, Artificial Sequence
  pSYN FVIII 310 (FVIII with complete B-domain deletion except 2 amino acid residues and 288 AE-XTEN inserted after aa 742)
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - DNA, 5900 bp, Artificial Sequence
  pSYN FVIII 312 (FVIII with complete B-domain deletion except 5 amino acid residues and 288 AE-XTEN inserted after aa 745- FVIII B5 version)
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatg

SEQ ID NO: 173 - protein, 1947 aa, Artificial Sequence
  pSYN FVIII 312 (FVIII with complete B-domain deletion except 5 amino acid residues and 288 AE-XTEN inserted after aa 745- FVIII B5 version)
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - DNA, 4977 bp, Artificial Sequence
  pSYN VWF073 (VWFD1D2D'D3- 144 AE XTEN- FVIII truncated a2 thrombin site-Fc)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcggcggtggaggatccggtggcgggggatccggtggcgggggatccggtggcgggggatccggtggcgggggatccggtggcgggggatccattgaaccaagaagcttctctggcagcggaggcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 175 - protein, 1658 aa, Artificial Sequence
  pSYN VWF073 (VWFD1D2D'D3- 144 AE XTEN- truncated a2 thrombin site-Fc)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSGGGGSGGGGSGGGGSGGGGSGGGGSGGGGSIEPRSFSGSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 25 aa, Artificial Sequence
  Cleavable linker
YEDSYEDISAYLLSKNNAIEPRSFS

SEQ ID NO: 177 - protein, 24 aa, Artificial Sequence
  Cleavable linker
EDSYEDISAYLLSKNNAIEPRSFS

SEQ ID NO: 178 - protein, 23 aa, Artificial Sequence
  Cleavable linker
DSYEDISAYLLSKNNAIEPRSFS

SEQ ID NO: 179 - protein, 22 aa, Artificial Sequence
  Cleavable linker
SYEDISAYLLSKNNAIEPRSFS

SEQ ID NO: 180 - protein, 21 aa, Artificial Sequence
  Cleavable linker
YEDISAYLLSKNNAIEPRSFS

SEQ ID NO: 181 - protein, 20 aa, Artificial Sequence
  Cleavable linker
EDISAYLLSKNNAIEPRSFS

SEQ ID NO: 182 - protein, 19 aa, Artificial Sequence
  Cleavable linker
DISAYLLSKNNAIEPRSFS

SEQ ID NO: 183 - protein, 18 aa, Artificial Sequence
  Cleavable linker
ISAYLLSKNNAIEPRSFS

SEQ ID NO: 184 - protein, 17 aa, Artificial Sequence
  Cleavable linker
SAYLLSKNNAIEPRSFS

SEQ ID NO: 185 - protein, 16 aa, Artificial Sequence
  Cleavable linker
AYLLSKNNAIEPRSFS

SEQ ID NO: 186 - protein, 15 aa, Artificial Sequence
  Cleavable linker
YLLSKNNAIEPRSFS

SEQ ID NO: 187 - protein, 14 aa, Artificial Sequence
  Cleavable linker
LLSKNNAIEPRSFS

SEQ ID NO: 188 - protein, 13 aa, Artificial Sequence
  Cleavable linker
LSKNNAIEPRSFS

SEQ ID NO: 189 - protein, 12 aa, Artificial Sequence
  Cleavable linker
SKNNAIEPRSFS

SEQ ID NO: 190 - protein, 11 aa, Artificial Sequence
  Cleavable linker
KNNAIEPRSFS

SEQ ID NO: 191 - protein, 10 aa, Artificial Sequence
  Cleavable linker
NNAIEPRSFS

SEQ ID NO: 192 - protein, 9 aa, Artificial Sequence
  Cleavable linker
NAIEPRSFS

SEQ ID NO: 193 - protein, 8 aa, Artificial Sequence
  Cleavable linker
AIEPRSFS

SEQ ID NO: 194 - protein, 7 aa, Artificial Sequence
  Cleavable linker
IEPRSFS

SEQ ID NO: 195 - protein, 6 aa, Artificial Sequence
  Cleavable linker
EPRSFS

SEQ ID NO: 196 - DNA, 4959 bp, Artificial Sequence
  pSYN VWF059 (VWF D'D3-Fc with acidic region 2 (a2) thrombin site in the linker)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgatatctgacaagaacactggtgattattacgaggacagttatgaagatatttcagcatacttgctgagtaaaaacaatgccattgaaccaagaagcttctctgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 197 - protein, 1652 aa, Artificial Sequence
  pSYN VWF059 (VWF D'D3-Fc with LVPR thrombin site in the linker)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASISDKNTGDYYEDSYEDISAYLLSKNNAIEPRSFSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 4860 bp, Artificial Sequence
  pSYN VWF062 (VWF D'D3-Fc with no thrombin site in the linker)
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgccgcattctgcgacaccattgctgcctatgcccacgtgtgtgcccagcatggcaaggtggtgacctggaggacggccacattgtgcccccagagctgcgaggagaggaatctccgggagaacgggtatgaggctgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgatatcgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 199 - protein, 1619 aa, Artificial Sequence
  pSYN VWF062 (VWF D'D3-Fc with no thrombin site in the linker)
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPISGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 4 aa, Artificial Sequence
  Cleavable linker
IEPR

SEQ ID NO: 201 - protein, 477 aa, Artificial Sequence
  VWF D'D3
SLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCAAFCDTIAAYAHVCAQHGKVVTWRTATLCPQSCEERNLRENGYEAEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEP

SEQ ID NO: 202 - protein, 1429 aa, Artificial Sequence
  FVIII with complete B-domain deletion except 5 amino acid residues
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

What is claimed is:

1. A chimeric protein comprising:
   (i) a first polypeptide chain which comprises a Factor VIII ("FVIII") protein fused to a first immunoglobulin ("Ig") constant region or a portion thereof,
      wherein the FVIII protein comprises the amino acid sequence of residues 1 to 745 of SEQ ID NO: 202, fused to a first XTEN sequence inserted immediately downstream of residue 745 of SEQ ID NO: 202, fused to residues 746 to 1429 of SEQ ID NO: 202; and
      wherein the first XTEN sequence comprises the amino acid sequence of SEQ ID NO: 8; and
   (ii) a second polypeptide chain which comprises a von Willebrand Factor ("VWF") protein comprising a D' domain and a D3 domain of VWF fused to a second Ig constant region or a portion thereof by a second XTEN sequence in-between,
      wherein the VWF protein comprises the amino acid sequence of SEQ ID NO: 201;
      wherein the second XTEN sequence comprises the amino acid sequence of SEQ ID NO: 58; and
      wherein the second XTEN sequence is linked to the second Ig constant region or a portion thereof by a linker comprising the amino acid sequence of SEQ ID NO: 88;
   wherein the first polypeptide chain is associated with the second polypeptide chain through the first Ig constant region or a portion thereof and the second Ig constant region or a portion thereof.

2. The chimeric protein of claim 1, wherein the first Ig constant region or a portion thereof comprises a first Fc region and the second Ig constant region or a portion thereof comprises a second Fc region.

3. The chimeric protein of claim 1, wherein the first Ig constant region or a portion thereof is associated with the second Ig constant region or a portion thereof by a covalent bond.

4. The chimeric protein of claim 1, wherein the FVIII protein comprises a deletion of residues 746-1648 corresponding to native mature human FVIII protein (SEQ ID NO: 65).

5. A pharmaceutical composition comprising the chimeric protein of claim 1 and a pharmaceutically acceptable carrier.

6. The chimeric protein of claim 1, wherein the first Ig constant region or a portion thereof is associated with the second Ig constant region or a portion thereof by a disulfide bond.

7. The chimeric protein of claim 1, wherein the first polypeptide chain comprises an amino acid sequence at least 99% identical to SEQ ID NO: 173.

8. The chimeric protein of claim 1, wherein the first polypeptide chain comprises the amino acid sequence of SEQ ID NO: 173.

9. The chimeric protein of claim 1, wherein the second XTEN sequence is fused to the linker such that the second polypeptide chain comprises the amino acid sequence of SEQ ID NO: 22.

10. The chimeric protein of claim 1, wherein the second XTEN sequence is linked to the second Ig constant region or a portion thereof by a linker consisting of the amino acid sequence of SEQ ID NO: 88.

11. The chimeric protein of claim 9, wherein the first XTEN sequence is inserted into the FVIII protein such that the first polypeptide chain comprises the amino acid sequence of SEQ ID NO: 2.

12. The chimeric protein of claim 2, wherein the first Fc region and the second Fc region are identical.

13. The chimeric protein of claim 2, wherein the first Fc region and the second Fc region are derived from human IgG1.

14. The chimeric protein of claim 1, wherein the first Ig constant region or a portion thereof is associated with the second Ig constant region or a portion thereof by two disulfide bonds.

15. The chimeric protein of claim 1, wherein the VWF protein consists of the D' domain and the D3 domain.

16. The chimeric protein of claim 1, wherein the VWF protein further comprises the D1 and D2 domains of VWF.

17. The chimeric protein of claim 16, wherein the VWF protein further comprises a signal peptide of VWF.

18. The chimeric protein of claim 17, wherein the FVIII protein further comprises a signal peptide of FVIII.

19. The chimeric protein of claim 17, wherein the second polypeptide chain comprises an amino acid sequence at least 90% identical to SEQ ID NO: 197.

20. The chimeric protein of claim 1, wherein the second polypeptide chain comprises an amino acid sequence at least 99% identical to SEQ ID NO: 197.

21. A chimeric protein comprising:
   (i) a first polypeptide chain comprising a Factor VIII ("FVIII") protein, a first XTEN sequence that is inserted in the FVIII protein, and a first Fc region, wherein the first polypeptide chain comprises an amino acid sequence at least 99% identical to the amino acid sequence of SEQ ID NO: 173; and
   (ii) a second polypeptide chain comprising a von Willebrand Factor ("VWF") protein, a second XTEN sequence, a linker comprising the amino acid sequence of SEQ ID NO: 88, and a second Fc region, wherein the second polypeptide chain comprises an amino acid sequence at least 99% identical to the amino acid sequence of SEQ ID NO: 197;
   wherein the first polypeptide chain and the second polypeptide chain are associated through a disulfide bond between the first Fc region and the second Fc region.

22. The chimeric protein of claim 21, wherein the FVIII protein further comprises a signal peptide of FVIII.

23. The chimeric protein of claim 21, wherein the first polypeptide chain and the second polypeptide chain are associated through two disulfide bonds between the first Fc region and the second Fc region.

24. A chimeric protein comprising:
   (i) a first polypeptide chain which comprises, from the N-terminus to the C-terminus thereof:
      (a) a Factor VIII ("FVIII") protein comprising the amino acid sequence of residues 1 to 745 of SEQ ID NO: 65, fused to a first XTEN sequence inserted immediately downstream of residue 745 of SEQ ID NO: 65, fused to residues 1649 to 2332 of SEQ ID NO: 65, and
      (b) a first Fc region;
      wherein the first XTEN sequence comprises the amino acid sequence of SEQ ID NO: 8; and
   (ii) a second polypeptide chain which comprises, from the N-terminus to the C-terminus thereof:
      (a) a von Willebrand Factor ("VWF") protein comprising a D' domain and a D3 domain of VWF, wherein the VWF protein comprises the amino acid sequence of residues 764 to 1240 of SEQ ID NO: 21 with alanine substitutions at residues 1099 and 1142 of SEQ ID NO: 21, (b) a second XTEN sequence comprising the amino acid sequence of SEQ ID NO: 58,
(c) a cleavable linker comprising the amino acid sequence of SEQ ID NO: 88, and
(d) a second Fc region;
wherein the first Fc region is associated with the second Fc region through a disulfide bond.

25. The chimeric protein of claim 24, wherein the first Fc region is associated with the second Fc region through two disulfide bonds.

26. The chimeric protein of claim 24, wherein the second XTEN sequence links the VWF protein to the cleavable linker, such that the second polypeptide chain comprises the amino acid sequence of SEQ ID NO: 22.

27. The chimeric protein of claim 26, wherein the first XTEN sequence is inserted into the FVIII protein such that the first polypeptide chain comprises the amino acid sequence of SEQ ID NO: 2.

28. The chimeric protein of claim 27, wherein the first polypeptide chain comprises an amino acid sequence at least 99% identical to the amino acid sequence of SEQ ID NO: 173.

29. The chimeric protein of claim 28, wherein the VWF protein consists of the D' domain and the D3 domain.

30. A chimeric protein comprising:
(i) a first polypeptide chain which comprises, from the N-terminus to the C-terminus thereof:
(a) a Factor VIII ("FVIII") protein comprising a N-terminal portion and a C-terminal portion;
wherein the N-terminal portion of the FVIII protein comprises the A1 domain, A2 domain, and a portion of the B domain of full length mature FVIII (SEQ ID NO: 65);
wherein the N-terminal portion comprises the amino acid sequence of residues 1 to 745 of SEQ ID NO: 65 fused to a first XTEN sequence inserted immediately downstream of amino acid 745 of SEQ ID NO: 65; and
wherein the C-terminal portion comprises the A3 domain, the C1 domain, and the C2 domain, such that the C-terminal portion comprises residues 1690-2332 of SEQ ID NO: 65;
(b) a first immunoglobulin ("Ig") constant region or a portion thereof, wherein the first XTEN sequence comprises the amino acid sequence of SEQ ID NO: 8; and
(ii) a second polypeptide chain which comprises, from the N-terminus to the C-terminus thereof:
(a) a von Willebrand Factor ("VWF") protein comprising a D' domain and a D3 domain of VWF, wherein the VWF protein contains a residue other than cysteine substituted for a residue corresponding to residues 1099 and 1142 of SEQ ID NO: 21;
(b) a second XTEN sequence comprising the amino acid sequence of SEQ ID NO: 58, wherein the second XTEN sequence contains less than 288 amino acid residues;
(c) a cleavable linker comprising an a2 region of FVIII which comprises the amino acid sequence of Glu720 to Arg740 corresponding to SEQ ID NO: 65, wherein the a2 region is capable of being cleaved by thrombin; and
(d) a second Ig constant region or a portion thereof, wherein the first polypeptide chain is associated with the second polypeptide chain through the first Ig constant region or a portion thereof and the second Ig constant region or a portion thereof.

31. The chimeric protein of claim 30, wherein the C-terminal portion of the FVIII protein comprises an amino acid sequence at least 95% identical to residues 1641 to 2332 of SEQ ID NO: 65.

32. The chimeric protein of claim 31, wherein the VWF protein contains an alanine substitution at residue 1099 and residue 1142 of SEQ ID NO: 21.

33. The chimeric protein of claim 32, wherein the first Ig constant region or a portion thereof is associated with the second Ig constant region or a portion thereof by a covalent bond.

34. The chimeric protein of claim 33, wherein the first Ig constant region or a portion thereof is associated with the second Ig constant region or a portion thereof by a disulfide bond.

35. The chimeric protein of claim 34, wherein the first Ig constant region or a portion thereof comprises a first Fc region and the second Ig constant region or a portion thereof comprises a second Fc region.

36. The chimeric protein of claim 35, wherein the first Fc region and the second Fc region are the same.

37. The chimeric protein of claim 36, wherein the first Fc region and the second Fc region are derived from human IgG1.

38. The chimeric protein of claim 37, wherein the VWF protein consists of the D' domain and the D3 domain.

39. The chimeric protein of claim 37, wherein the VWF protein further comprises the D1 and D2 domain of VWF.

40. The chimeric protein of claim 39, wherein the VWF protein further comprises a signal peptide of VWF.

41. The chimeric protein of claim 40, wherein the FVIII protein further comprises a signal peptide of FVIII.

42. The chimeric protein of claim 30, wherein the cleavable linker comprises an a2 region of FVIII comprising an amino acid sequence at least 90% identical to SEQ ID NO: 106.

43. A pharmaceutical composition comprising the chimeric protein of claim 30 and a pharmaceutically acceptable carrier.

44. A chimeric protein comprising:
(i) a first polypeptide chain which comprises, from the N-terminus to the C-terminus thereof:
(a) a Factor VIII ("FVIII") protein comprising an amino acid sequence that is at least 99% identical to SEQ ID NO: 67 with a first XTEN sequence inserted immediately downstream of the residue corresponding to residue 745 of SEQ ID NO: 67; and
(b) a first Fc region;
wherein the first XTEN sequence comprises the amino acid sequence of SEQ ID NO: 8; and
(ii) a second polypeptide chain which comprises, from the N-terminus to the C-terminus thereof:
(a) a von Willebrand Factor ("VWF") protein comprising a D' domain and a D3 domain of VWF, wherein the VWF protein contains a residue other than cysteine substituted for residues 1099 and 1142 of SEQ ID NO: 21;
(b) a second XTEN sequence comprising the amino acid sequence of SEQ ID NO: 58, wherein the second XTEN sequence contains less than 288 amino acid residues;
(c) a cleavable linker comprising an a2 region of FVIII which comprises the amino acid sequence of Glu720 to Arg740 corresponding to SEQ ID NO: 65, wherein the a2region is capable of being cleaved by thrombin; and (d) a second Fc region,
wherein the first Fc region is associated with the second Fc region through a disulfide bond.

45. The chimeric protein of claim 44, wherein the VWF protein contains an alanine substitution at residue 1099 and residue 1142 of SEQ ID NO: 21.

46. The chimeric protein of claim 45, wherein the first Fc region and the second Fc region are the same.

47. The chimeric protein of claim 45, wherein the first Fc region and the second Fc region are derived from human IgG1.

48. The chimeric protein of claim 47, wherein the VWF protein consists of the D' domain and the D3 domain.

49. The chimeric protein of claim 47, wherein the VWF protein further comprises the D1 and D2 domain of VWF.

50. The chimeric protein of claim 49, wherein the VWF protein further comprises a signal peptide of VWF.

51. The chimeric protein of claim 50, wherein the FVIII protein further comprises a signal peptide of FVIII.

52. The chimeric protein of claim 47, wherein the first Fc region is associated with the second Fc region through two disulfide bonds.

53. The chimeric protein of claim 44, wherein the cleavable linker comprises an a2 region of FVIII comprising an amino acid sequence at least 90% identical to SEQ ID NO: 106.

54. A pharmaceutical composition comprising the chimeric protein of claim 44 and a pharmaceutically acceptable carrier.

55. The chimeric protein of claim 30, wherein the cleavable linker is 20 to 50 amino acids long.

56. The chimeric protein of claim 44, wherein the cleavable linker is 20 to 50 amino acids long.

57. The chimeric protein of claim 30, wherein the cleavable linker is about 30 amino acids long.

58. The chimeric protein of claim 44, wherein the cleavable linker is about 30 amino acids long.

* * * * *